United States Patent 12,397,048 (BUNYAVIRALES VACCINE) - sequence listing, part 2

SEQ ID NO: 2002 - protein, 1314 aa, synthetic construct
  REGION 1..1314: note = derived and/or modified protein sequence (wt) from PTV(Adames)__DQ363407.1__GP
MIFTILNVLTRAMLVMSMYSLTTWDSSSRNDICFSNDSPLEGLVYYWETHSKKHDYKKQGSQKCRVGDSDKKMISNVTIISLISEIQKSISELSLSCGNNDNSTGQVLTFNGLEDTIRGDYIVDCVTGLYQSDIGVGVGLGRINHDHQQVKNKAVVIDEKEKMISLLETQQSENDIKTQVLMSEIEQLKNQLSKRRNERGQEKRDAEKLMSDLMARNSDLRNHNVILTDEISQIKNNITIHRNRNMMSTTVVPAILSVALLSSSVGPITAAPPDSTMINPWPHAKNRVGTGMYKYDENDESGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDIYSGPKIPFKGVCKIGLIKYKECKFKTSSYETISFITLKGKGKIYIEHLMLKNIEVVTNVSFVCYEHAGQDDEQEVEHRALKRVSVNDCKIVDNSKQKICTGDHIFCEKYDCSTSYPDVTCIHTPGSGPLYINLMGSWIKPQCVGYERVLVDREVKQPLLVPEQNCDTCVSECLDEGVHIKSTGFEITSAVACSHGSCISAHQEASTSVIIPYPGLLASVGGRIGIHLSHTSDSASVHMVVVCPPRDSCAAHNCLLCYHGILNYQCHSTLSAILTSFLLILFIYTAFSVTTNVLYVLRLIPKQLKSPVGWLKLFVNWLLTALRIKTRRVMGRINQRIGWVDHHDVERPRHREPMRRFKTTLLLTLIMVTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGEMELVTLGSLGTKFLNWGTLSLSLDAEGISGTNSISFLESSKGGFALYDEGYSEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIIFINKVKSCDATFLNVSGCYSCDYGAHVCVKVKSSESADFFAESEDKTTVLSFPIQSGTRDYCQVLHFQKPLVDERLSYSCGSEPKLIVIKGTLVYMGVYDFRDKTGGSSTVINPSEGTWSISNWFSGLLDWLGGPMKAILKILGFIAIGIVCFILFMILIRIAVNSINIKKKN

SEQ ID NO: 2003 - protein, 1313 aa, synthetic construct
  REGION 1..1313: note = derived and/or modified protein sequence (wt) from PTV__M11156.1__GP
MIFTILNVLTRAMLVMSMYSLTTWDSTSRNDMCFSNDSPLEGLVYYWETHSKRHDYKKQESQRCRVGDSDKKMITNVTIISLISEIQKSISELSLSCVNDDNSTGQVLTFNGLEDTIRGDYIVDCVTGLYQSDIGVGVGLGRTHHGHQQMKNKAVVIDEKERMISLLETQQSENDIKMQVLMSEIEQLKNQLSKKRNERGQEKRDAEKVMSDLMARNSDLRKHNDILTAEISQMKNKNTIQRNKNTVSTTVVPAILSVALLSSSVAPIIAAPPDSPMINPWPHAKNRVGTGMYKYDENDDSGCRPIRYGVSCIGFDFMLKMDKYPFFNAFIGHKTPLESFADKIIEKEEETCEIGTNKEFKCFEERAYIKGTCPTNINAVHYIDNKGKLRYVKCKENLEMTEDCAFCRKIKKKAGQSVQVQKTSVPLQDAICQENSDTYSGPKIPFKGVCKIGLIKYKECKFKTSSYETVSFITLKEKGKIYIEHLMLKNIEVVTNVSFVCYEHVGQDEQEVEHRALKRVSVNDCKIVDNSKQKICTGDHVFCEKYDCSTSYPDVTCIHAPGSGPLYINLMGSWIKPQCVGYERVLVDREVKQPLLAPEQNCDTCVSECLDEGVHIKSTGFEITSAVACSHGSCISAHQEPSTSVIVPYPGLLASVGGRIGIHLSHTSDSASVHMVVVCPPRDSCAAHNCLLCYHGILNYQCHSTLSAILTSFLLILFIYTVFSVTTNILYVLRLIPKQLKSPVGWLKLFINWLLTALRIKTRNVMRRINQRIGWVDHHDVERPRHREPMRRFKTTLLLTLIMMTGGNACSNTVVANSKQTRCVQEGSNTKCSITATITLRAGVIGAESCFIIKGPMENQQKTISIKTISSETVCREGSSFWTSLYIPSCLSSRRCHLVGDCVGNKCQSWRDDQLSREFSGVKDNHIMNENKCFEQCGAIGCGCFNINPSCLYVHAYLKSARNEAVRVFSCSDWVHRVSFEVKGPDGETELVTLGSPGTKFLNWGTLSLSLDAEGISGTNSISFLESSKGGFALYDEGYNEIPREGFLGEIRCSSESAAISAHKSCIRAPGLIKYKPMTDQIECTASLVDPFAIFLKGSLPQTRNGQTFTSTKDKKTVQAFTNGAIKALLSINLDDHEIVFINKVKNCDATFLNVSGCYSCDYGAHVCVKVKSSESADFFAESEDKTTVLSFPIQSGTHDYCQVLHFQKPLVDERLSYSCGSEPKLIVIKGTLVCMGVYDFRNKTGGSSTVVNPSEGAWSISNWFSGLLDWLGGPMKAILKILGFIAIGIVCFVLFMILIRIAVNSINIKKKN

SEQ ID NO: 2004 - protein, 1283 aa, synthetic construct
  REGION 1..1283: note = derived and/or modified protein sequence (wt) from Phlebovirus(CoAr170255)__HM566149.1__GP
MYKLITNILKLSVVSAMYSIMFWDPTGISKLCLSNNSPLEGLVYYWENTMREGEFKREKRKKCRLGISEPAPVSNQTIVSLIEEVQKSPAEMILICEANGNSTGSSLSFDGLSDNEIKPSIVDCTTGDRTSDLRVLVGKGIFEKKMSMSNEIDRVVSLEDHLQREKELVQTFQDLHHNESEKNKLLEHELENVRQQLKRERESNKIKMWTTKRPEITTIGLTTTIATILLASQSVASSVPMPGQLNTWPHAKNRVGGGVFKANDDDEDSCKLIDYGIACHGFDYLLRTDIYPFFNAHVSHRSLLEASNEGIILKDEASCEIETNKDFKCYEERAFLKWSCPHLVNSAHFIDSKGKLRIIKCKAEYEITEDCTYCRRIKKKAAQQKQVYKSSIALQDAVCQENSDYYDGPRITFTGVCKIGTMEYKKCKHKSSSFENIGFITIRDKGKYYIENMRTKNIEMVSNVSFICYNHNGQDTEKDVRLLKRVKPGDCKVVDDSKTKHCTGDHVFCEKYDCTKSYPEATCMHAPGSGPILVLVMGVWFKPQCVGYERVLVEREVKAPVLIQEKDCDTCVFECLEDKILIKSTGFKMISAVACSHGSCVSSHQSPSTFLYIDYPGLTASVGGEIGLHLSHTDDSVSVHKKIHCPARDPCEAHSCIVCYHGLVNYQCHTVLSYSVVSFLLVCMMYLAFFITSRLLFFLRIMPRRLRNPISWLTLLIRWVLQTLLAILRLSFKKLSETIGWNSPNNRQQMDVEANRRPLRRYRTTFILTLLFVGLTSACSNTAVSNSKQTKCLQSGGSVKCSITATITLKAGTIGAESCFIIKGPSENQQKVIRVKTVSSETVCREGSSFWTGQFTPSCVSSRRCHLVGDCVGNRCQAWRDEVVSREFGNMKDNNVMSENKCFEQCGAAGCGCFNINPSCLYVHSTFKSVRREAIRVFKCNDWVHRLTFEVSGPSGEKDRIVLNSLSTKFLQWGTISLSLDAEGISGTNSYSFLESNKGGFAIHDEEFSEIPREGYLGEIRCSSESAVIAAHKSCIRAPNLIKYKPMTDQIDCTASLVDPFAIFLKGSLPQSRSGYTFTSSTDKKTVQAFNSGSIKALISINMDDHEIEFLNDAADCDATFLNVSGCYSCNYGAQVCIKVRSSKSSIFSSNNNDNSIVINFDADQGTRDYCRIIHFNGPLVDETLHYSCGGESKLLQMKGSLITVGPYDFRNTTGGKSTIVNPHEESWNLFSWFSGLLDWLGGPLRAILKIVLIIIIGIILFIVVAFLIRLVIFNVLLKSKKN

SEQ ID NO: 2005 - protein, 1290 aa, synthetic construct
  REGION 1..1290: note = derived and/or modified protein sequence (wt) from Phlebovirus(CoAr171616)__HM566154.1__GP
MFQIIYLLTKLYLVSSMYSIMFWENENISKLCLSNNSPLEGLVYYWENVMKEGDFKEEKRKKCRIGPSDLKRVTNQTLTTLIEEVQKSPSEIQLLCEEDGNKTGISMFFDGLSDDISTPSIVDCNGNIRISDLRVQVGRGHFEKENEIRKIEEIVTLEDDLRRERDLNKLLQDLNKKDAEERRIIEHELTNMREQLQRERERSKQQIKEHEKIEVNNHKEPATHLNVSKLLTIGLLAQQVGQVIATEPGQLNTWIHAKNRIGKGLYKTEDTDEDGCRGLDYGVSCLGFDYLLRTDIYPFFNSFVSHLSMLEASTEDLIEKEGTSCEIETNKEFKCYEERAFIKGSCPHLVNSAHFLDNKGKLRIVKCKTDFEMTEDCTFCRKIKKKNSQHKQVFKTSIALQDAVCQNNSDLYNGPRIVYSNVCKIGMVSYKQCKSKTSSYESVGFVILKGKGKFYIENMKIKNIEVIANVSFICHQYQGQDGTEKEQRSLKRISVGECKSVNPQKTKHCTGDHVFCEKYDCTKSYPEVTCLMAPGSGPILVQIMGSWIKPQCVGYEKVLVEREVKSPTLTEERDCDTCVYECLEDKILIKSTGFKMISAVACSHGMCVSSHQEPSTFLYINYPGMSASIGGEIGLHLSHTDDSLSLHKVISCPSRNPCDVHSCIICYHGIINYQCHTALSYTIVAFSFISFLYLTFKVISQLLYTFKVVPKKLKGPFYWMGYLIKWIVKTILGVVRNTFFTMSNRIGWERRDEIHEDIEANPRRHLQRFKTTFVLTMLMINGGLCCSNTLVSNSKQTRCVQSGNEVKCSVSATVVLKAGVIGAESCFIIKGPSENQHKMISVRTLSSETVCREGASFWTGHFSPSCVSSRRCHLVGECHGNRCQSWRDDQISREFGGVKDNNRMSENKCFEQCGSIGCGCFNMNPSCLYVHTTLKSARNEAVRVFKCNDWIHRLNFEVIGPSGEKDVVTLNSMSTKFLQWGTISLSLDAEGITGTNSYSFLESSKGGFAIHDEEFSDIPREGYLGEIRCSSESAVISAHSSCIRAPDLIKYKPMTDQIECTSTLIDPFAIFMKGSLPQTRSGYTFTSSKDKKTIQAFNTNSIKALISLNLDDHEIVFVSDQTNCECTFLNLTGCYSCDYGAHVCFRIKSDKKGVFVSNTEAKDISFGFEVLTGTHDYCQIQHFNSPSVYKTLSYSCGGESKLLVIKGSLITIGPHDYRNKTGGASTVVNPSEEGWSVTNWIGGFISWLGGPLKALLKIAVTILAGVVIFLIIYFFLRLIATNILMKTKKN

SEQ ID NO: 2006 - protein, 1283 aa, synthetic construct
  REGION 1..1283: note = derived and/or modified protein sequence (wt) from Buenaventura virus(CoAr3319)__KP272002.1__GP
MYKLITNILKLSMVSAMYSIMFWDPTGISKLCLSNNSPLEGLVYYWENTMREGEFKREKRKKCRLGISEPAPVSNQTIVSLIEEVQKSPAEMILICETSGNATGSSLSFDGLSDNEVKPSIVDCATGERTSDLRVLVGKGTFEKKMSMSNEIDRVVSLEDHLQRERELVQTFQDLHHNESEKNKLLEHELENVRQQLRRERESNKVKVWTTKKPEVTTIGLTTTIATILLASQSIASSVPMPGQLNTWPHAKNRVGGGVFKANDDDEDSCKLIDYGIACHGFDYLLRTDIYPFFNAHVSHRSMLEASNEGIILKDEASCEIETNKDLKCYEERAFLKWSCPHLVNSAHFIDSKGKLRIIKCKAEYEITEDCTYCRRIKKKAAQQKQVYKSSIALQDAVCQENSDYYDGPRITFTGVCKIGSMEYKKCKHKSSSFENVGFITIRDKGKYYIENMRIKNIEMVSNVSFICYNHNGQDTEKDIRLLKRVKPSDCKVVDDSKSKHCTGDHIFCDKYDCTKSYPEASCMHAPGSGPILVLVMGVWFKPQCVGYERVLVEREVKVPVLTQEKDCDTCVFECQEDKILIKSTGFKMISAVACSHGSCVSSHQSPSTFLYIDYPGLTASVGGEIGLHLSHTDDSISVHKKIHCPARDPCEAHNCVICYHGLINYQCHTFLSYSVVSFLFISVLYLTFFIVSRLLLFLKIMPKRLKNPISWLTLLIRWVLQTLITILRLSFKKLSETIGWTTNDNRQHVDVEANRRPLRRYRTTFILTLLFIGLASGCSNTAVSNSKQTKCLQSGGSVKCSITATITLKAGIIGAESCFIIKGPSENQQRVIRVKTISSETVCREGSSFWTGLFTPSCVSSRRCHLVGDCVGNRCQSWRDEVVSREFGNMKDNNAMSENKCFEQCGAAGCGCFNINPSCLYVHSVFKSVRREAIRVFKCNDWVHRLTFEVSGPSGEKDRIVLNSLSTKFLQWGTISLSLDAEGISGTNSYSFLESNKGGFAIHDEEFSEIPREGYLGEIRCSSESAVIAAHKSCIRAPNLIKYKPMTDQIDCTASLVDPFAIFLKGSLPQSRSGYTFTSSTDKKTVQAFNSGAIKALISINLDDHEIEFLSDTADCDATFLNISGCYSCNYGAQVCIKVRSSKSSIFSSNNNDNSIVINFDAEQGTRDYCRIIHFNGPLVDETLHYSCGGESKLLQMKGSLITVGPYDFRNTTGGKSTVVNPHEESWNLFSWFSGLLDWLGGPLRAILKIVLIVIIGIILFIVVVFLMRLAILNVLLKSKKN

SEQ ID NO: 2007 - protein, 1313 aa, synthetic construct
  REGION 1..1313: note = derived and/or modified protein sequence (wt) from Cocle virus(GML244915)__KP272034.1__GP
MMFTHLDVLTRAMLVMSMYSLTTWDSIRRNDICFSNDSPLEGLVYYWETQSKMHEYKKEDSQKCRVGDSEKKMISNVTIISLISEIQKSISELSLSCGNDDNSTGQVLMFNGLEDTIRGDYIVDCLTGLYQSDIGVGVGSGKTKHDHTKLRNKAVIIDEKEKMISLLEAQQSENDIKTQVLMSEIEQLKTQLLNRRSERGHEKRKNEEIVSDLMARNSDLRKHNDILKDEMDQIKENLTIFKSRNAISTTSVPAIMSIALLSSSVMPIIAAVSDSPMINPWPHAKNRVGSGMYKYDDNDESGCRPIRYGVSCIGFDHMLKMDKYPFFNAFIGHKTLLESFVDKIIEKEDETCEIGTNKEFKCFEERAYIKGTCPHNINAVHYLDNKGKLRYVKCKENLEMTEDCAFCRKIKKKAGQSVQVQKTSVPLQDAICQDNSDIYTGPRIPYKGMCKIGLVKYKECKSKTSSYETVSFITLKGKGKIYIEHLMLKNIEVVTNVSFVCYEHAGQVEQEVEHRALKRVSVNDCKIVDSSKQKICTGDHVFCEKYDCSTSYPDVTCIQAPGSGPLYVNLMGSWIKPQCVGYERVLVEREVKQPLLTPEQNCDTCVSECLDEGVHIKSTGFEITSAVACSHGSCISAHQEASTSIIVPYPGLLASVGGKIGLHLSHTSDSASVHMIVVCPPRDSCAAHNCLLCYHGMLNYQCHSTLSAILTSFLLILFIYTTFSFITNILYLLRLLPKQLKSPIGWLKLFINWLFTILRIRTKYLMGRLNQRIGWVENHDVERPRPREPMRRFKTTLMLTMLMITGGYACSNTVVANSKQTRCVQEGSNTKCSVTATVTLKAGVIGAESCFVIKGPMENQQKTISIKTVSSETVCREGSSFWTSLYIPSCLSSRRCHLVGDCVGNRCQSWREDQLSREFSGVKDNQIMNENKCFEQCGAIGCGCFNINPSCLYVHAYLKSARNEAVRVFSCSDWVHRVSFEVKGPDGETELVTLGSLGTKFLNWGTLSLSLDAEGITGTNSLSFLESSKGGFALYDEGFSEIPREGFLGEIRCSSESAAISAHKSCIRAPGLIKYKPMTDQIECTASLVDPFAIFLKGSLPQTRNGQTFTSTKDKKTVQAFTTGAIRALLSINLDDHEITFISKIKNCEATFLNVSGCYSCDYGAHVCIKIKSSESADFYAESEDKTTVLSLPVSSGTQDYCQVLHFQKPLVDERLSYSCGSEPKLMVIKGTLVYMGVYDFRNKTGGSSTVVNPSDASWSIANWFSGLLDWLGGPLKAILKILGFIAMGVVCFILFMILIKIAVRSVNMKKKN

SEQ ID NO: 2008 - protein, 1290 aa, synthetic construct
  REGION 1..1290: note = derived and/or modified protein sequence (wt) from Campana virus(VP-334K)__KP272041.1__GP
MLHFITITTKFLAVASMYNLLYWDPNGLSRLCLSNNSPLEGLVYYWENLMKESDFKKDKKKHCRIGTSVAAPVTNETLTTLIEEVQKSPSEIILQCESRNNDTGNSIYFDGLADDIESPSIVNCESGKRESDLRVLVGQGLKKEIILNEIAAIDRQASLEEHLRGEKALTSLLQEISKQDEAERKRLEHEVSSLRQQLMNEREENKKRKNIPAFGVSSTTSSSLMNISRVVTIGLLSQQAIANPSLPGQVNTWPHAKNRIGQGLYRIDTSDEDGCRGLNYGVICLGFDHLLRMDLYPFFNAYVSHLSLLEAYTENIIQKDETECEIEGGKEFKCYEERAYIKGVCPHRIKSAHYLDQKGKLRIIKCKENLELTEDCTYCRKIKKDRGHTKQVYKTSVPLQDAICQDNSDDYSGPKISFKGVCKIGMIEYKECKYKSSSFETVGFITIKEKGKFYIEDMKLKNLEVTNNVAFICHQYTGQDGTTDEENRHLKRMSVKDCKNVNSSKSKYCTGDHIFCQVYDCTKSYPEATCFVAPGSGPVLVQVMGSWIKPQCVGYEKVLVEREVKMPILTEERDCDTCVYECKEDHILIKSTGFNMISAVACSHGSCVSAHQDPSTFLNIEYPGMSASVGGEIGIHISHTDDSLSLHKKIYCPARDSCEAHNCIMCYHGLINYQCHTALSYAVVSFMFVSIAYVIFNVLRLVLVALHVVPRKLKSPIDWLILLIKWVFLLLAKVIRAFLTHLNTTIGWRERQNNFAADLEAQRRPLQRFKTTVLLMMMLISVVSSCSNSVVSNSKQTRCIQSGSNTKCSVSATITLKAGVIGAESCFVIKGPSENQHKTIVIRTVSSETICREGSSFWTGHFTPSCLSSRRCHLVGDCVGSRCQGWREDVISREFGGVKDNNQMSENKCFEQCGAAGCGCFNINPSCLYVHTILRSARNEAVRVFKCNDWVHKLTFHIKGPNGEEEDVVLNSLSTKFLSWGTISLSLDSEGITGTNSYSFLESSKGGFAIHDEEFSEIPREGFLGEIRCSSESAVVSAHKSCIRAPGLIKYKPMTDQVECSASLVDPFAIFIKGSLPQTRSGYTFTSSRDKRTIQAFNNGAIKALLTLNLDDHEVIFSESVITCECTFLNISGCYSCNFGAQVCFKIKSSGIGDFVSSSETGNILFSFPVKSGTEDYCQIQHFNSPMVSESLQYSCGGESKLLLIKGSLISVGPYDYRNKTGGSSTVVNPAEDSWSIFNWLSGFLDWLGGPLRALVKIALAIIGALALLFITIMLARSVISNTLSRKKKN

SEQ ID NO: 2009 - protein, 1197 aa, synthetic construct
  REGION 1..1197: note = derived and/or modified protein sequence (wt) from RVFV(ZH-548)__DQ380206.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2010 - protein, 1197 aa, synthetic construct
  REGION 1..1197: note = derived and/or modified protein sequence (wt) from RVFV(ZS-6365)__DQ380205.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2011 - protein, 1197 aa, synthetic construct
  REGION 1..1197: note = derived and/or modified protein sequence (wt) from RVFV(CAR-R1622)__DQ380219.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2012 - protein, 1197 aa, synthetic construct
  REGION 1..1197: note = derived and/or modified protein sequence (wt) from RVFV(2250/74)__DQ380209.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGAKVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2013 - protein, 1197 aa, synthetic construct
  REGION 1..1197: note = derived and/or modified protein sequence (wt) from RVFV(T1)__DQ380201.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2014 - protein, 1197 aa, synthetic construct
  REGION 1..1197: note = derived and/or modified protein sequence (wt) from RVFV(1853/78)__DQ380220.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2015 - protein, 1197 aa, synthetic construct
  REGION 1..1197: note = derived and/or modified protein sequence (wt) from RVFV(MP-12)__DQ380208.1__GP
MYVLLTILTSVLVCEAIIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2016 - protein, 1197 aa, synthetic construct
  REGION 1..1197: note = derived and/or modified protein sequence (wt) from RVFV(ZM-657)__DQ380204.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYAKAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2017 - protein, 1197 aa, synthetic construct
  REGION 1..1197: note = derived and/or modified protein sequence (wt) from RVFV(ZH-501-777)__DQ380202.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDPGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2018 - protein, 1197 aa, synthetic construct
  REGION 1..1197: note = derived and/or modified protein sequence (wt) from RVFV(OS-3)__DQ380184.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2019 - protein, 1197 aa, synthetic construct
  REGION 1..1197: note = derived and/or modified protein sequence (wt) from RVFV(Sudan 86-2010)__JQ820489.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVIFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2020 - protein, 1197 aa, synthetic construct
  REGION 1..1197: note = derived and/or modified protein sequence (wt) from RVFV(T-46 (228113))__DQ380199.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTKDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2021 - protein, 1197 aa, synthetic construct
  REGION 1..1197: note = derived and/or modified protein sequence (wt) from RVFV(2007000094)__EU574055.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2022 - protein, 1197 aa, synthetic construct
  REGION 1..1197: note = derived and/or modified protein sequence (wt) from RVFV(ZC-3349)__DQ380207.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQAVSSKIVAHCPPQDPCLVHGCIVCAHGLINYQCHTALSAFVVVFVFSSIAIICLAILYRVLKCLKIAPRKVLNPLMWITAFIRWIYKKMVARVADNINHVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLKAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2023 - protein, 1197 aa, synthetic construct
  REGION 1..1197: note = derived and/or modified protein sequence (wt) from RVFV(2007001602)__EU574043.1__GP
MYVLLTILISVLVCEAVIRVSISSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2024 - protein, 1197 aa, synthetic construct
  REGION 1..1197: note = derived and/or modified protein sequence (wt) from RVFV(1260/78)__DQ380214.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILHRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2025 - protein, 1197 aa, synthetic construct
  REGION 1..1197: note = derived and/or modified protein sequence (wt) from RVFV(2007000324)__JF326195.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2026 - protein, 1197 aa, synthetic construct
  REGION 1..1197: note = derived and/or modified protein sequence (wt) from RVFV(KEN/Gar-Msq/131B-04/06)__HM586972.1__GP
MYVLLTILISVLVCEAVIRVSLSSTREETCFGDSTNPEMIEGAWDSFREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2027 - protein, 1197 aa, synthetic construct
  REGION 1..1197: note = derived and/or modified protein sequence (wt) from RVFV(2007004194)__EU574031.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLSNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2028 - protein, 1197 aa, synthetic construct
  REGION 1..1197: note = derived and/or modified protein sequence (wt) from RVFV(73HB1230)__DQ380221.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQVGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKKELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTIMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2029 - protein, 1197 aa, synthetic construct
  REGION 1..1197: note = derived and/or modified protein sequence (wt) from RVFV(73HB1449)__DQ380211.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2030 - protein, 1197 aa, synthetic construct
  REGION 1..1197: note = derived and/or modified protein sequence (wt) from RVFV(ZH-548M12)__M25276.1__GP
MYVLLTILTSVLVCEAIIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRKTMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2031 - protein, 1197 aa, synthetic construct
  REGION 1..1197: note = derived and/or modified protein sequence (wt) from RVFV(ZINGA J83 R1)__KU978776.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRLMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2032 - protein, 1197 aa, synthetic construct
  REGION 1..1197: note = derived and/or modified protein sequence (wt) from RVFV(Sudan 28-2010)__JQ820491.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVVLSIGLFFLLIYLGRTGLSKMWLAATKKAS

SEQ ID NO: 2033 - protein, 1197 aa, synthetic construct
  REGION 1..1197: note = derived and/or modified protein sequence (wt) from RVFV(2007001292)__EU574046.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNLFDWFSGLMSWFGGPLKTILLICLYVALSIGLFFLLIYLGRTGLSKMWLAATKKAS

SEQ ID NO: 2034 - protein, 1197 aa, synthetic construct
  REGION 1..1197: note = derived and/or modified protein sequence (wt) from RVFV(Sudan 85-2010)__JQ820488.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2035 - protein, 1197 aa, synthetic construct
  REGION 1..1197: note = derived and/or modified protein sequence (wt) from RVFV(2007002060)__EU574039.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRKDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2036 - protein, 1197 aa, synthetic construct
  REGION 1..1197: note = derived and/or modified protein sequence (wt) from RVFV(2007002476)__EU574036.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIKWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2037 - protein, 1197 aa, synthetic construct
  REGION 1..1197: note = derived and/or modified protein sequence (wt) from RVFV(2269/74)__DQ380222.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQHKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2038 - protein, 1197 aa, synthetic construct
  REGION 1..1197: note = derived and/or modified protein sequence (wt) from RVFV(SA-51 (Van Wyck))__DQ380195.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGRGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEVTDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2039 - protein, 1197 aa, synthetic construct
  REGION 1..1197: note = derived and/or modified protein sequence (wt) from RVFV(OS-8)__DQ380185.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLRIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLSGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2040 - protein, 1197 aa, synthetic construct
  REGION 1..1197: note = derived and/or modified protein sequence (wt) from RVFV(BIME-01)__KX609032.1__GP
MYVLLTILISVLVCEAIIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2041 - protein, 1197 aa, synthetic construct
  REGION 1..1197: note = derived and/or modified protein sequence (wt) from RVFV(Kenya 83 (21445))__DQ380198.1__GP
MYVLLTILISVLVCEAVIRVSLSSTREETCFGDSTNPEMIEGAWDSLREEEMPEELSCSISGIREVKTSSQELYRALKAIIAADGLNNITCHGKNPENKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2042 - protein, 1197 aa, synthetic construct
  REGION 1..1197: note = derived and/or modified protein sequence (wt) from RVFV(2007000253)__JF326192.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSAGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2043 - protein, 1197 aa, synthetic construct
  REGION 1..1197: note = derived and/or modified protein sequence (wt) from RVFV(200803166)__JF311381.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLKKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYATACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHVVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2044 - protein, 1197 aa, synthetic construct
  REGION 1..1197: note = derived and/or modified protein sequence (wt) from RVFV(2007001107)__EU574047.1__GP
MYVLLTILISVLVCEAVIRVSLSSTREETCFGDSTNPEMIEGAWDSLREEEMPEELSCSVSGIREVKTSNQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2045 - protein, 1197 aa, synthetic construct
  REGION 1..1197: note = derived and/or modified protein sequence (wt) from RVFV(ANK-3837)__DQ380215.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGKLDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2046 - protein, 1197 aa, synthetic construct
  REGION 1..1197: note = derived and/or modified protein sequence (wt) from RVFV(OS-1)__DQ380186.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERQRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALKVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2047 - protein, 1197 aa, synthetic construct
  REGION 1..1197: note = derived and/or modified protein sequence (wt) from RVFV(Sudan 2V-2007)__JQ820490.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCSVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSHASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLMAIDPFDDRREAGGESTVVNPKSGSWNFFDWFSGLMSWFGGPLKTILLICLYVALSIGLFFLLIYLGRTGLSKMWLAATKKAS

SEQ ID NO: 2048 - protein, 1197 aa, synthetic construct
  REGION 1..1197: note = derived and/or modified protein sequence (wt) from RVFV(200803162)__JF311377.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCIAKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVIFVFSSTAIICLAVLYRVLKCLKIAPRKVLNPLMWITAFIRWVYKKMVARVADNINQVNREIGWMEGGQLALRNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2049 - protein, 1197 aa, synthetic construct
  REGION 1..1197: note = derived and/or modified protein sequence (wt) from RVFV(2007001811)__EU574040.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLMIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2050 - protein, 1197 aa, synthetic construct
  REGION 1..1197: note = derived and/or modified protein sequence (wt) from RVFV(clone 13)__DQ380213.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2051 - protein, 1197 aa, synthetic construct
  REGION 1..1197: note = derived and/or modified protein sequence (wt) from RVFV(MP12)__Z30318.1__GP
MYVLLTILTSVLVCEAIIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRKTMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVAHNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2052 - protein, 1197 aa, synthetic construct
  REGION 1..1197: note = derived and/or modified protein sequence (wt) from RVFV__JQ068143.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTIDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2053 - protein, 1197 aa, synthetic construct
  REGION 1..1197: note = derived and/or modified protein sequence (wt) from RVFV(2007002445)__EU574037.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNEKTFAASKGNRGVQAFSKGSIQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2054 - protein, 1197 aa, synthetic construct
  REGION 1..1197: note = derived and/or modified protein sequence (wt) from RVFV(2008/00101)__HE687306.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTTLLICLYVALSIGLFFLLIYLGRTGLSKMWLAATKKAS

SEQ ID NO: 2055 - protein, 1197 aa, synthetic construct
  REGION 1..1197: note = derived and/or modified protein sequence (wt) from RVFV(Hv-B375)__DQ380218.1__GP
MYVLLTILISVLVCEAVIRVSLSSTREETCFGDSTNPEMIEGAWDSLREGEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKNELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2056 - protein, 1197 aa, synthetic construct
  REGION 1..1197: note = derived and/or modified protein sequence (wt) from RVFV(763/70)__DQ380188.1__GP
MYVLLTILITVLVCEAVIRVSLSSTREETCFGDSTNPEMIEGAWDSLREEEMPEELSCSISGIREVKTSSQELYRALKAIIAADGLNNITCHGKDPEDKISLVKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYGLTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2057 - protein, 1197 aa, synthetic construct
  REGION 1..1197: note = derived and/or modified protein sequence (wt) from RVFV(RVFBJ01/2016)__KX785331.1__GP
MYVLLTILISVLVCEAIIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2058 - protein, 1197 aa, synthetic construct
  REGION 1..1197: note = derived and/or modified protein sequence (wt) from RVFV(Lunyo)__KU167026.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMVSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTRCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2059 - protein, 1197 aa, synthetic construct
  REGION 1..1197: note = derived and/or modified protein sequence (wt) from RVFV(2007000234)__JF326191.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIRRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2060 - protein, 1197 aa, synthetic construct
  REGION 1..1197: note = derived and/or modified protein sequence (wt) from RVFV(KEN07-KUR340)__EF460404.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRMLKCLKIAPRIVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2061 - protein, 1197 aa, synthetic construct
  REGION 1..1197: note = derived and/or modified protein sequence (wt) from RVFV(2373/74)__DQ380194.1__GP
MYVLLTILISVLVCEAVIRVSLSSTREETCFGDSTNPEMIEGAWDSLREEEMPEELSCSISGIREVKTSSQELYRALKAIIAADGLNNITCYGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKMVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTLDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2062 - protein, 1197 aa, synthetic construct
  REGION 1..1197: note = derived and/or modified protein sequence (wt) from RVFV(200803169)__JF311384.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKVDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEVRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2063 - protein, 1197 aa, synthetic construct
  REGION 1..1197: note = derived and/or modified protein sequence (wt) from RVFV(200803167)__JF311382.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDLHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEIALKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTMLLICLYVALSIGLFFLLIYLGRTGLSKMWLAATKKAS

SEQ ID NO: 2064 - protein, 1197 aa, synthetic construct
  REGION 1..1197: note = derived and/or modified protein sequence (wt) from RVFV(Entebbe)__DQ380191.1__GP
MYALLTILISVLVCEAVIRVSLSSTREETCFGDSTNPEMIEGAWDSLREEEMPEELSCSISGIREVKTSSQELHRALKAIIAADGLNNITCHGKDPEDKISLIKGPPHKKRVGVVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2065 - protein, 1197 aa, synthetic construct
  REGION 1..1197: note = derived and/or modified protein sequence (wt) from RVFV(25010-24)__KM210509.1__GP
MYVLLTILISVLVCEAVIRVSLSSTREETCFGDSTNPEMIERAWDSLREEEMPEELSCSISGIREVKTSSQELYRALKAIIAADGLNNITCHGKDPEDKISLIKGPPHKKRVGIVRCERRRDAKQVGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLIVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2066 - protein, 1197 aa, synthetic construct
  REGION 1..1197: note = derived and/or modified protein sequence (wt) from RVFV(Kenya 9800523)__DQ380196.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDTKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLNAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKEGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2067 - protein, 1197 aa, synthetic construct
  REGION 1..1197: note = derived and/or modified protein sequence (wt) from RVFV(ANK-6087)__DQ380216.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGKLDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECSTNLIDPFVVFKRGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2068 - protein, 1197 aa, synthetic construct
  REGION 1..1197: note = derived and/or modified protein sequence (wt) from RVFV(SAUDI 200010901)__KU978778.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCGRRRDTKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2069 - protein, 1197 aa, synthetic construct
  REGION 1..1197: note = derived and/or modified protein sequence (wt) from RVFV(35/74)__JF784387.1__GP
MYVLLTILITVLVCEAVIRVSLSSTREETCFGDYTNPEMIEGAWDSLREEEMPEELSCSISGIREVKTSSQELYRALKAIIAADGLNNITCHGKDPEDKISLVKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLDPLMWITVFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2070 - protein, 1197 aa, synthetic construct
  REGION 1..1197: note = derived and/or modified protein sequence (wt) from RVFV(KEN/Kil-006/07)__HM586966.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGVVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2071 - protein, 1197 aa, synthetic construct
  REGION 1..1197: note = derived and/or modified protein sequence (wt) from RVFV(MgH824)__DQ380210.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGYNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFERKGQYKGTMDSGQTKRELKSFDISQCPKIGGHGSKKCTGDAAFCSAYECTTQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVDTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFPEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2072 - protein, 1197 aa, synthetic construct
  REGION 1..1197: note = derived and/or modified protein sequence (wt) from RVFV(Kenya 57 (Rintoul))__DQ380192.1__GP
MYALLTILISVLVCEAVIRVSLSSTREETCFGDSTNPEMIEGAWDSLREEEMPEELSCSISGIREVKTSSQELHRALKAIIAADGLNNITCHGKDPEDKISLIKGPPHKKRVGVVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEISRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2073 - protein, 1197 aa, synthetic construct
  REGION 1..1197: note = derived and/or modified protein sequence (wt) from RVFV(SA-75)__DQ380189.1__GP
MYVLLTILITVLVCEAVIRVSLSSTREETCFGDYTNPEMIEGAWDSLREEEMPEELSCSISGIREVKTSSQELYRALKAIIAADGLNNITCHGKDPEDKISLVKGPPHKKRVGIVRCERRRDAKQIGRETMARIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITVFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2074 - protein, 1197 aa, synthetic construct
  REGION 1..1197: note = derived and/or modified protein sequence (wt) from RVFV(SA01-1322)__KX096942.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCGRRRDTKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGDPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2075 - protein, 1197 aa, synthetic construct
  REGION 1..1197: note = derived and/or modified protein sequence (wt) from RVFV(KEN/Mal-032/07)__HM586967.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2076 - protein, 1197 aa, synthetic construct
  REGION 1..1197: note = derived and/or modified protein sequence (wt) from RVFV(KEN/Gar-008/06)__HM586965.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNLKVDFVGAAVSCDAAFLNLTGCYSCNAGARVCLSITSTGTGTLSAHNKDGSLHIVLPSENGTKDQCQILHFTVPEVKEEFMYSCDGDERALLMKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2077 - protein, 1197 aa, synthetic construct
  REGION 1..1197: note = derived and/or modified protein sequence (wt) from RVFV(Kenya 56 (IB8))__DQ380190.1__GP
MYVLLTILITVLVCEAVIRVSLSSTREETCFGDSTSPEMIEGAWDSLREEEMPEELSCSISGIREVKTSSQELYRALKAIIAADGLNNITCHGKDPEDKISLIKGPPHKKQVGIVRCERRRDAKQIGRETMAGIAMTVLPALAVFALAPVVFAEDPHLRNRPGKGHNYIDGMTQGDATCKPVTYAGACSSFDVLLEKGKFPLFQSYAHHRTLLEAVHDTIIAKADPPSCDLQSAHGNPCMKEKLVMKTHCPKDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKRPLCVGYERVVVKRELSAKPIQRVEPCTTCITKCEPHGLVVRSTGFKISSAVACASGVCVTGSQSPSTEITLKYPGMSQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQPALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVAFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2078 - protein, 1197 aa, synthetic construct
  REGION 1..1197: note = derived and/or modified protein sequence (wt) from RVFV(KEN/Bar-035/07)__HM586969.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRARSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2079 - protein, 1197 aa, synthetic construct
  REGION 1..1197: note = derived and/or modified protein sequence (wt) from RVFV(TAN/Dod-002/07)__HM586971.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGRKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAQAWIISQWHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2080 - protein, 1197 aa, synthetic construct
  REGION 1..1197: note = derived and/or modified protein sequence (wt) from RVFV(Beijing-01)__KX611606.1__GP
MYVLLTILISVLVFEVVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGVTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGRLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVFDCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMFEGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2081 - protein, 1197 aa, synthetic construct
  REGION 1..1197: note = derived and/or modified protein sequence (wt) from RVFV(Smithburn)__DQ380193.1__GP
MYVLLTILISVLVCEAVIRVSLSSTREETCFGDSTNPEMIEGAWDSLREEEMPEELSCSISGIREVKTSSQELYRALKATIAADGLNNITCHGKDPEDKISLIKGPPHKKRVGVVRCERQRDAKQIGRGTMAGIAMTVFPALVVFALAPVVFAEDPHLRNRPGKGHNYIDGMTQEDATCKPVTYAGACSSFDVLLEKGKFPLFQSYAHHRTLLEAVHDIIIAKADPPSCNLQSAHGNPCMKEKLVMKTYCPNDYQSAHYLNNDGKMASVKCPPKHELTEDCNFCRQMTGASLKEGSYPLQDLFCQSSEDDGSKLKTKMKGVCEVGVQVLKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTAFSAFVVVFVFSSVVIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFFLIYLGRTGLSKMWLAATKKAS

SEQ ID NO: 2082 - protein, 1197 aa, synthetic construct
  REGION 1..1197: note = derived and/or modified protein sequence (wt) from RVFV(KEN/Bar-032/07)__HM586968.1__GP
MYVLLTILISVLVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSVGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSHTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2083 - protein, 1197 aa, synthetic construct
  REGION 1..1197: note = derived and/or modified protein sequence (wt) from RVFV(KEN/Gar-004/06)__HM586964.1__GP
MYVLLTILISVWVCEAVIRVSLSSTREETCFGDSTNPEMIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSQKVYLDKLDLKTEENLLPDSFVCFEHKGQYKGTMDSGQTKRELKSFDISQCPKIGGHGRKKRTGDAAFCSAYECTAQYANAYCSRANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINNQSHSALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2084 - protein, 1206 aa, synthetic construct
  REGION 1..1206: note = derived and/or modified protein sequence (wt) from RVFV(RVFV)__M11157.1__GP
MYVLLTILISVLVCEAVIRVSLSSTREETCFGDSTNPEMIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYGLTEDCNFCRQMTGASLKKGSYPLQDLFCQSSEDDGSKLKTKMKGVCEVGVQAHKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVAHNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSISPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPSKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKLYSSFACMLHYQLGSFSSLYILEEQASLKCGLLPLRRPHRSVRVKVIC

SEQ ID NO: 2085 - protein, 1159 aa, synthetic construct
  REGION 1..1159: note = derived and/or modified protein sequence (wt) from RVFV(ZH-548)__DQ380206.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2086 - protein, 1159 aa, synthetic construct
  REGION 1..1159: note = derived and/or modified protein sequence (wt) from RVFV(ZS-6365)__DQ380205.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2087 - protein, 1159 aa, synthetic construct
  REGION 1..1159: note = derived and/or modified protein sequence (wt) from RVFV(MP-12)__DQ380208.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2088 - protein, 1159 aa, synthetic construct
  REGION 1..1159: note = derived and/or modified protein sequence (wt) from RVFV(T1)__DQ380201.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2089 - protein, 1159 aa, synthetic construct
  REGION 1..1159: note = derived and/or modified protein sequence (wt) from RVFV(1853/78)__DQ380220.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2090 - protein, 1159 aa, synthetic construct
  REGION 1..1159: note = derived and/or modified protein sequence (wt) from RVFV(CAR-R1622)__DQ380219.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2091 - protein, 1159 aa, synthetic construct
  REGION 1..1159: note = derived and/or modified protein sequence (wt) from RVFV(2250/74)__DQ380209.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGAKVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2092 - protein, 1159 aa, synthetic construct
  REGION 1..1159: note = derived and/or modified protein sequence (wt) from RVFV(2007000094)__EU574055.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2093 - protein, 1159 aa, synthetic construct
  REGION 1..1159: note = derived and/or modified protein sequence (wt) from RVFV(ZM-657)__DQ380204.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYAKAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2094 - protein, 1159 aa, synthetic construct
  REGION 1..1159: note = derived and/or modified protein sequence (wt) from RVFV(ZH-548M12)__M25276.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRKTMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2095 - protein, 1159 aa, synthetic construct
  REGION 1..1159: note = derived and/or modified protein sequence (wt) from RVFV(ZH-501-777)__DQ380202.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDPGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2096 - protein, 1159 aa, synthetic construct
  REGION 1..1159: note = derived and/or modified protein sequence (wt) from RVFV(T-46 (228113))__DQ380199.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTKDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2097 - protein, 1159 aa, synthetic construct
  REGION 1..1159: note = derived and/or modified protein sequence (wt) from RVFV(OS-3)__DQ380184.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2098 - protein, 1159 aa, synthetic construct
  REGION 1..1159: note = derived and/or modified protein sequence (wt) from RVFV(Sudan 86-2010)__JQ820489.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVIFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2099 - protein, 1159 aa, synthetic construct
  REGION 1..1159: note = derived and/or modified protein sequence (wt) from RVFV(Sudan 28-2010)__JQ820491.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVVLSIGLFFLLIYLGRTGLSKMWLAATKKAS

SEQ ID NO: 2100 - protein, 1159 aa, synthetic construct
  REGION 1..1159: note = derived and/or modified protein sequence (wt) from RVFV(2007004194)__EU574031.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLSNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2101 - protein, 1159 aa, synthetic construct
  REGION 1..1159: note = derived and/or modified protein sequence (wt) from RVFV(73HB1230)__DQ380221.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQVGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKKELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTIMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2102 - protein, 1159 aa, synthetic construct
  REGION 1..1159: note = derived and/or modified protein sequence (wt) from RVFV(1260/78)__DQ380214.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILHRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2103 - protein, 1159 aa, synthetic construct
  REGION 1..1159: note = derived and/or modified protein sequence (wt) from RVFV(ZC-3349)__DQ380207.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQAVSSKIVAHCPPQDPCLVHGCIVCAHGLINYQCHTALSAFVVVFVFSSIAIICLAILYRVLKCLKIAPRKVLNPLMWITAFIRWIYKKMVARVADNINHVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLKAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2104 - protein, 1159 aa, synthetic construct
  REGION 1..1159: note = derived and/or modified protein sequence (wt) from RVFV(Sudan 85-2010)__JQ820488.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2105 - protein, 1159 aa, synthetic construct
  REGION 1..1159: note = derived and/or modified protein sequence (wt) from RVFV(2007000324)__JF326195.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2106 - protein, 1159 aa, synthetic construct
  REGION 1..1159: note = derived and/or modified protein sequence (wt) from RVFV(OS-8)__DQ380185.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLRIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLSGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2107 - protein, 1159 aa, synthetic construct
  REGION 1..1159: note = derived and/or modified protein sequence (wt) from RVFV(ZINGA J83 R1)__KU978776.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRLMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2108 - protein, 1159 aa, synthetic construct
  REGION 1..1159: note = derived and/or modified protein sequence (wt) from RVFV(2007000253)__JF326192.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSAGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2109 - protein, 1159 aa, synthetic construct
  REGION 1..1159: note = derived and/or modified protein sequence (wt) from RVFV(MP12)__Z30318.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRKTMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVAHNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2110 - protein, 1159 aa, synthetic construct
  REGION 1..1159: note = derived and/or modified protein sequence (wt) from RVFV(BIME-01)__KX609032.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2111 - protein, 1159 aa, synthetic construct
  REGION 1..1159: note = derived and/or modified protein sequence (wt) from RVFV(200803166)__JF311381.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLKKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYATACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHVVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2112 - protein, 1159 aa, synthetic construct
  REGION 1..1159: note = derived and/or modified protein sequence (wt) from RVFV(Kenya 83 (21445))__DQ380198.1__NSm-Gn-Gc
MIEGAWDSLREEEMPEELSCSISGIREVKTSSQELYRALKAIIAADGLNNITCHGKNPENKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2113 - protein, 1159 aa, synthetic construct
  REGION 1..1159: note = derived and/or modified protein sequence (wt) from RVFV(Entebbe)__DQ380191.1__NSm-Gn-Gc
MIEGAWDSLREEEMPEELSCSISGIREVKTSSQELHRALKAIIAADGLNNITCHGKDPEDKISLIKGPPHKKRVGVVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2114 - protein, 1159 aa, synthetic construct
  REGION 1..1159: note = derived and/or modified protein sequence (wt) from RVFV(763/70)__DQ380188.1__NSm-Gn-Gc
MIEGAWDSLREEEMPEELSCSISGIREVKTSSQELYRALKAIIAADGLNNITCHGKDPEDKISLVKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYGLTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2115 - protein, 1159 aa, synthetic construct
  REGION 1..1159: note = derived and/or modified protein sequence (wt) from RVFV(OS-1)__DQ380186.1__NSm-Gn-Gc
MIEGAWDSLREEEMPEELSCSISGIREVKTSSQELYRALKAIIAADGLNNITCHGKDPEDKISLIKGPPHKKRVGIVRCERQRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALKVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2116 - protein, 1159 aa, synthetic construct
  REGION 1..1159: note = derived and/or modified protein sequence (wt) from RVFV(2008/00101)__HE687306.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTTLLICLYVALSIGLFFLLIYLGRTGLSKMWLAATKKAS

SEQ ID NO: 2117 - protein, 1159 aa, synthetic construct
  REGION 1..1159: note = derived and/or modified protein sequence (wt) from RVFV(200803162)__JF311377.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCIAKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVIFVFSSTAIICLAVLYRVLKCLKIAPRKVLNPLMWITAFIRWVYKKMVARVADNINQVNREIGWMEGGQLALRNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2118 - protein, 1159 aa, synthetic construct
  REGION 1..1159: note = derived and/or modified protein sequence (wt) from RVFV(2007002060)__EU574039.1__NSm-Gn-Gc
MIEGAWDSLREEEMPEELSCSVSGIREVKTSSQELYRALKAIIAADGLNNITCHGKNPEDKISLIKGPPHKKRVGIVRCERRKDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2119 - protein, 1159 aa, synthetic construct
  REGION 1..1159: note = derived and/or modified protein sequence (wt) from RVFV(2007002476)__EU574036.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIKWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2120 - protein, 1159 aa, synthetic construct
  REGION 1..1159: note = derived and/or modified protein sequence (wt) from RVFV(2269/74)__DQ380222.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQHKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2121 - protein, 1159 aa, synthetic construct
  REGION 1..1159: note = derived and/or modified protein sequence (wt) from RVFV(73HB1449)__DQ380211.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2122 - protein, 1159 aa, synthetic construct
  REGION 1..1159: note = derived and/or modified protein sequence (wt) from RVFV(SA-51 (Van Wyck))__DQ380195.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGRGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEVTDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2123 - protein, 1159 aa, synthetic construct
  REGION 1..1159: note = derived and/or modified protein sequence (wt) from RVFV(KEN/Gar-Msq/131B-04/06)__HM586972.1__NSm-Gn-Gc
MIEGAWDSFREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2124 - protein, 1159 aa, synthetic construct
  REGION 1..1159: note = derived and/or modified protein sequence (wt) from RVFV(2007001107)__EU574047.1__NSm-Gn-Gc
MIEGAWDSLREEEMPEELSCSVSGIREVKTSNQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2125 - protein, 1159 aa, synthetic construct
  REGION 1..1159: note = derived and/or modified protein sequence (wt) from RVFV(ANK-3837)__DQ380215.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGKLDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2126 - protein, 1159 aa, synthetic construct
  REGION 1..1159: note = derived and/or modified protein sequence (wt) from RVFV(Lunyo)__KU167026.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMVSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTRCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2127 - protein, 1159 aa, synthetic construct
  REGION 1..1159: note = derived and/or modified protein sequence (wt) from RVFV(RVFBJ01/2016)__KX785331.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2128 - protein, 1159 aa, synthetic construct
  REGION 1..1159: note = derived and/or modified protein sequence (wt) from RVFV(Ken 199800523)__KU978777.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDTKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLNAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKEGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2129 - protein, 1159 aa, synthetic construct
  REGION 1..1159: note = derived and/or modified protein sequence (wt) from RVFV__JQ068143.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTIDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2130 - protein, 1159 aa, synthetic construct
  REGION 1..1159: note = derived and/or modified protein sequence (wt) from RVFV(200803169)__JF311384.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKVDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEVRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2131 - protein, 1159 aa, synthetic construct
  REGION 1..1159: note = derived and/or modified protein sequence (wt) from RVFV(2007002445)__EU574037.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNEKTFAASKGNRGVQAFSKGSIQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2132 - protein, 1159 aa, synthetic construct
  REGION 1..1159: note = derived and/or modified protein sequence (wt) from RVFV(Hv-B375)__DQ380218.1__NSm-Gn-Gc
MIEGAWDSLREGEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKNELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2133 - protein, 1159 aa, synthetic construct
  REGION 1..1159: note = derived and/or modified protein sequence (wt) from RVFV(clone 13)__DQ380213.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2134 - protein, 1159 aa, synthetic construct
  REGION 1..1159: note = derived and/or modified protein sequence (wt) from RVFV(Kenya 57 (Rintoul))__DQ380192.1__NSm-Gn-Gc
MIEGAWDSLREEEMPEELSCSISGIREVKTSSQELHRALKAIIAADGLNNITCHGKDPEDKISLIKGPPHKKRVGVVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEISRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2135 - protein, 1159 aa, synthetic construct
  REGION 1..1159: note = derived and/or modified protein sequence (wt) from RVFV(2007001292)__EU574046.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNLFDWFSGLMSWFGGPLKTILLICLYVALSIGLFFLLIYLGRTGLSKMWLAATKKAS

SEQ ID NO: 2136 - protein, 1159 aa, synthetic construct
  REGION 1..1159: note = derived and/or modified protein sequence (wt) from RVFV(2007001811)__EU574040.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLMIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2137 - protein, 1159 aa, synthetic construct
  REGION 1..1159: note = derived and/or modified protein sequence (wt) from RVFV(ANK-6087)__DQ380216.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGKLDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECSTNLIDPFVVFKRGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2138 - protein, 1159 aa, synthetic construct
  REGION 1..1159: note = derived and/or modified protein sequence (wt) from RVFV(2007000234)__JF326191.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIRRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2139 - protein, 1159 aa, synthetic construct
  REGION 1..1159: note = derived and/or modified protein sequence (wt) from RVFV(SA-75)__DQ380189.1__NSm-Gn-Gc
MIEGAWDSLREEEMPEELSCSISGIREVKTSSQELYRALKAIIAADGLNNITCHGKDPEDKISLVKGPPHKKRVGIVRCERRRDAKQIGRETMARIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITVFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2140 - protein, 1159 aa, synthetic construct
  REGION 1..1159: note = derived and/or modified protein sequence (wt) from RVFV(KEN07-KUR340)__EF460404.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRMLKCLKIAPRIVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2141 - protein, 1159 aa, synthetic construct
  REGION 1..1159: note = derived and/or modified protein sequence (wt) from RVFV(35/74)__JF784387.1__NSm-Gn-Gc
MIEGAWDSLREEEMPEELSCSISGIREVKTSSQELYRALKAIIAADGLNNITCHGKDPEDKISLVKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLDPLMWITVFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2142 - protein, 1159 aa, synthetic construct
  REGION 1..1159: note = derived and/or modified protein sequence (wt) from RVFV(200803167)__JF311382.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDLHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEIALKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTMLLICLYVALSIGLFFLLIYLGRTGLSKMWLAATKKAS

SEQ ID NO: 2143 - protein, 1159 aa, synthetic construct
  REGION 1..1159: note = derived and/or modified protein sequence (wt) from RVFV(25010-24)__KM210509.1__NSm-Gn-Gc
MIERAWDSLREEEMPEELSCSISGIREVKTSSQELYRALKAIIAADGLNNITCHGKDPEDKISLIKGPPHKKRVGIVRCERRRDAKQVGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLIVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2144 - protein, 1159 aa, synthetic construct
  REGION 1..1159: note = derived and/or modified protein sequence (wt) from RVFV(Sudan 2V-2007)__JQ820490.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCSVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSHASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLMAIDPFDDRREAGGESTVVNPKSGSWNFFDWFSGLMSWFGGPLKTILLICLYVALSIGLFFLLIYLGRTGLSKMWLAATKKAS

SEQ ID NO: 2145 - protein, 1159 aa, synthetic construct
  REGION 1..1159: note = derived and/or modified protein sequence (wt) from RVFV(SAUDI 200010901)__KU978778.1__NSm-Gn-Gc
MIEGAWDSLREEEMPEELSCSVSGIREVKTSSQELYRALKAIIAADGLNNITCHGKNPEDKISLIKGPPHKKRVGIVRCGRRRDTKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2146 - protein, 1159 aa, synthetic construct
  REGION 1..1159: note = derived and/or modified protein sequence (wt) from RVFV(2373/74)__DQ380194.1__NSm-Gn-Gc
MIEGAWDSLREEEMPEELSCSISGIREVKTSSQELYRALKAIIAADGLNNITCYGKDPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKMVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTLDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2147 - protein, 1159 aa, synthetic construct
  REGION 1..1159: note = derived and/or modified protein sequence (wt) from RVFV(KEN/Kil-006/07)__HM586966.1__NSm-Gn-Gc
MIEGAWDSLREEEMPEELSCSVSGIREVKTSSQELYRALKAIIAADGLNNITCHGKNPEDKISLIKGPPHKKRVGVVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2148 - protein, 1159 aa, synthetic construct
  REGION 1..1159: note = derived and/or modified protein sequence (wt) from RVFV(MgH824)__DQ380210.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGYNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFERKGQYKGTMDSGQTKRELKSFDISQCPKIGGHGSKKCTGDAAFCSAYECTTQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVDTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFPEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2149 - protein, 1159 aa, synthetic construct
  REGION 1..1159: note = derived and/or modified protein sequence (wt) from RVFV(SA01-1322)__KX096942.1__NSm-Gn-Gc
MIEGAWDSLREEEMPEELSCSVSGIREVKTSSQELYRALKAIIAADGLNNITCHGKNPEDKISLIKGPPHKKRVGIVRCGRRRDTKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGDPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2150 - protein, 1159 aa, synthetic construct
  REGION 1..1159: note = derived and/or modified protein sequence (wt) from RVFV(Kenya 56 (IB8))__DQ380190.1__NSm-Gn-Gc
MIEGAWDSLREEEMPEELSCSISGIREVKTSSQELYRALKAIIAADGLNNITCHGKDPEDKISLIKGPPHKKQVGIVRCERRRDAKQIGRETMAGIAMTVLPALAVFALAPVVFAEDPHLRNRPGKGHNYIDGMTQGDATCKPVTYAGACSSFDVLLEKGKFPLFQSYAHHRTLLEAVHDTIIAKADPPSCDLQSAHGNPCMKEKLVMKTHCPKDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKRPLCVGYERVVVKRELSAKPIQRVEPCTTCITKCEPHGLVVRSTGFKISSAVACASGVCVTGSQSPSTEITLKYPGMSQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQPALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVAFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2151 - protein, 1159 aa, synthetic construct
  REGION 1..1159: note = derived and/or modified protein sequence (wt) from RVFV(KEN/Mal-032/07)__HM586967.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2152 - protein, 1159 aa, synthetic construct
  REGION 1..1159: note = derived and/or modified protein sequence (wt) from RVFV(KEN/Gar-008/06)__HM586965.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNLKVDFVGAAVSCDAAFLNLTGCYSCNAGARVCLSITSTGTGTLSAHNKDGSLHIVLPSENGTKDQCQILHFTVPEVKEEFMYSCDGDERALLMKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2153 - protein, 1159 aa, synthetic construct
  REGION 1..1159: note = derived and/or modified protein sequence (wt) from RVFV(Beijing-01)__KX611606.1__NSm-Gn-Gc
MIEGAWDSLREEEMPEELSCSISGIREVKTSSQELYRALKAIIAADGLNNITCHGKDPEDKISLIKGPPHKKRVGIVRCERRRDAKQIGRETMAGIAMTVLPALAVFALAPVVFAEDPHLRNRPGKGHNYIDGVTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGRLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVFDCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMFEGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2154 - protein, 1159 aa, synthetic construct
  REGION 1..1159: note = derived and/or modified protein sequence (wt) from RVFV(KEN/Bar-035/07)__HM586969.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRARSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2155 - protein, 1159 aa, synthetic construct
  REGION 1..1159: note = derived and/or modified protein sequence (wt) from RVFV(KEN/Bar-032/07)__HM586968.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSVGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSHTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2156 - protein, 1159 aa, synthetic construct
  REGION 1..1159: note = derived and/or modified protein sequence (wt) from RVFV(TAN/Dod-002/07)__HM586971.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGRKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAQAWIISQWHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2157 - protein, 1159 aa, synthetic construct
  REGION 1..1159: note = derived and/or modified protein sequence (wt) from RVFV(Smithburn)__DQ380193.1__NSm-Gn-Gc
MIEGAWDSLREEEMPEELSCSISGIREVKTSSQELYRALKATIAADGLNNITCHGKDPEDKISLIKGPPHKKRVGVVRCERQRDAKQIGRGTMAGIAMTVFPALVVFALAPVVFAEDPHLRNRPGKGHNYIDGMTQEDATCKPVTYAGACSSFDVLLEKGKFPLFQSYAHHRTLLEAVHDIIIAKADPPSCNLQSAHGNPCMKEKLVMKTYCPNDYQSAHYLNNDGKMASVKCPPKHELTEDCNFCRQMTGASLKEGSYPLQDLFCQSSEDDGSKLKTKMKGVCEVGVQVLKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTAFSAFVVVFVFSSVVIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFFLIYLGRTGLSKMWLAATKKAS

SEQ ID NO: 2158 - protein, 1159 aa, synthetic construct
  REGION 1..1159: note = derived and/or modified protein sequence (wt) from RVFV(KEN/Gar-004/06)__HM586964.1__NSm-Gn-Gc
MIEGAWDSLREEEMPEELSCSVSGIREVKTSSQELYRALKAIIAADGLNNITCHGKNPEDKISLIKGPPHKKRVGIVRCERRRDAKQIGRETMAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSQKVYLDKLDLKTEENLLPDSFVCFEHKGQYKGTMDSGQTKRELKSFDISQCPKIGGHGRKKRTGDAAFCSAYECTAQYANAYCSRANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINNQSHSALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2159 - protein, 1067 aa, synthetic construct
  REGION 1..1067: note = derived and/or modified protein sequence (wt) from RVFV(ZH-548)__DQ380206.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2160 - protein, 1067 aa, synthetic construct
  REGION 1..1067: note = derived and/or modified protein sequence (wt) from RVFV(2007000094)__EU574055.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2161 - protein, 1067 aa, synthetic construct
  REGION 1..1067: note = derived and/or modified protein sequence (wt) from RVFV(ZH-548M12)__M25276.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2162 - protein, 1067 aa, synthetic construct
  REGION 1..1067: note = derived and/or modified protein sequence (wt) from RVFV(Sudan 86-2010)__JQ820489.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVIFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2163 - protein, 1067 aa, synthetic construct
  REGION 1..1067: note = derived and/or modified protein sequence (wt) from RVFV(ZS-6365)__DQ380205.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2164 - protein, 1067 aa, synthetic construct
  REGION 1..1067: note = derived and/or modified protein sequence (wt) from RVFV(1853/78)__DQ380220.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2165 - protein, 1067 aa, synthetic construct
  REGION 1..1067: note = derived and/or modified protein sequence (wt) from RVFV(T1)__DQ380201.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2166 - protein, 1067 aa, synthetic construct
  REGION 1..1067: note = derived and/or modified protein sequence (wt) from RVFV(Kenya 83 (21445))__DQ380198.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2167 - protein, 1067 aa, synthetic construct
  REGION 1..1067: note = derived and/or modified protein sequence (wt) from RVFV(Sudan 85-2010)__JQ820488.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2168 - protein, 1067 aa, synthetic construct
  REGION 1..1067: note = derived and/or modified protein sequence (wt) from RVFV(2007004194)__EU574031.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLSNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2169 - protein, 1067 aa, synthetic construct
  REGION 1..1067: note = derived and/or modified protein sequence (wt) from RVFV(2250/74)__DQ380209.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGAKVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2170 - protein, 1067 aa, synthetic construct
  REGION 1..1067: note = derived and/or modified protein sequence (wt) from RVFV(Sudan 28-2010)__JQ820491.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVVLSIGLFFLLIYLGRTGLSKMWLAATKKAS

SEQ ID NO: 2171 - protein, 1067 aa, synthetic construct
  REGION 1..1067: note = derived and/or modified protein sequence (wt) from RVFV(2007000324)__JF326195.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2172 - protein, 1067 aa, synthetic construct
  REGION 1..1067: note = derived and/or modified protein sequence (wt) from RVFV(ZM-657)__DQ380204.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYAKAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2173 - protein, 1067 aa, synthetic construct
  REGION 1..1067: note = derived and/or modified protein sequence (wt) from RVFV(T-46 (228113))__DQ380199.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTKDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2174 - protein, 1067 aa, synthetic construct
  REGION 1..1067: note = derived and/or modified protein sequence (wt) from RVFV(MP12)__Z30318.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVAHNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2175 - protein, 1067 aa, synthetic construct
  REGION 1..1067: note = derived and/or modified protein sequence (wt) from RVFV(200803166)__JF311381.1__Gn-Gc
MAGIAMTVLPALAVFALAPVVFAEDPHLRNRPGKGHNYIDGMTQEDATCKPVTYAGACSSFDVLLKKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYATACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHVVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2176 - protein, 1067 aa, synthetic construct
  REGION 1..1067: note = derived and/or modified protein sequence (wt) from RVFV(200803162)__JF311377.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCIAKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVIFVFSSTAIICLAVLYRVLKCLKIAPRKVLNPLMWITAFIRWVYKKMVARVADNINQVNREIGWMEGGQLALRNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2177 - protein, 1067 aa, synthetic construct
  REGION 1..1067: note = derived and/or modified protein sequence (wt) from RVFV(Hv-B375)__DQ380218.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKNELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2178 - protein, 1067 aa, synthetic construct
  REGION 1..1067: note = derived and/or modified protein sequence (wt) from RVFV(1260/78)__DQ380214.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILHRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2179 - protein, 1067 aa, synthetic construct
  REGION 1..1067: note = derived and/or modified protein sequence (wt) from RVFV(ZH-501-777)__DQ380202.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDPGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2180 - protein, 1067 aa, synthetic construct
  REGION 1..1067: note = derived and/or modified protein sequence (wt) from RVFV(OS-3)__DQ380184.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2181 - protein, 1067 aa, synthetic construct
  REGION 1..1067: note = derived and/or modified protein sequence (wt) from RVFV(SAUDI 200010901)__KU978778.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2182 - protein, 1067 aa, synthetic construct
  REGION 1..1067: note = derived and/or modified protein sequence (wt) from RVFV(2007001811)__EU574040.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLMIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2183 - protein, 1067 aa, synthetic construct
  REGION 1..1067: note = derived and/or modified protein sequence (wt) from RVFV(2007000253)__JF326192.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSAGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2184 - protein, 1067 aa, synthetic construct
  REGION 1..1067: note = derived and/or modified protein sequence (wt) from RVFV(2007001292)__EU574046.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNLFDWFSGLMSWFGGPLKTILLICLYVALSIGLFFLLIYLGRTGLSKMWLAATKKAS

SEQ ID NO: 2185 - protein, 1067 aa, synthetic construct
  REGION 1..1067: note = derived and/or modified protein sequence (wt) from RVFV(2007002476)__EU574036.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIKWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2186 - protein, 1067 aa, synthetic construct
  REGION 1..1067: note = derived and/or modified protein sequence (wt) from RVFV(73HB1230)__DQ380221.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKKELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTIMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2187 - protein, 1067 aa, synthetic construct
  REGION 1..1067: note = derived and/or modified protein sequence (wt) from RVFV(ZINGA J83 R1)__KU978776.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRLMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2188 - protein, 1067 aa, synthetic construct
  REGION 1..1067: note = derived and/or modified protein sequence (wt) from RVFV(2008/00101)__HE687306.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTTLLICLYVALSIGLFFLLIYLGRTGLSKMWLAATKKAS

SEQ ID NO: 2189 - protein, 1067 aa, synthetic construct
  REGION 1..1067: note = derived and/or modified protein sequence (wt) from RVFV(2007002445)__EU574037.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNEKTFAASKGNRGVQAFSKGSIQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2190 - protein, 1067 aa, synthetic construct
  REGION 1..1067: note = derived and/or modified protein sequence (wt) from RVFV(ZC-3349)__DQ380207.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQAVSSKIVAHCPPQDPCLVHGCIVCAHGLINYQCHTALSAFVVVFVFSSIAIICLAILYRVLKCLKIAPRKVLNPLMWITAFIRWIYKKMVARVADNINHVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLKAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2191 - protein, 1067 aa, synthetic construct
  REGION 1..1067: note = derived and/or modified protein sequence (wt) from RVFV(Kenya 9800523)__DQ380196.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLNAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKEGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2192 - protein, 1067 aa, synthetic construct
  REGION 1..1067: note = derived and/or modified protein sequence (wt) from RVFV(Entebbe)__DQ380191.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2193 - protein, 1067 aa, synthetic construct
  REGION 1..1067: note = derived and/or modified protein sequence (wt) from RVFV(25010-24)__KM210509.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLIVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2194 - protein, 1067 aa, synthetic construct
  REGION 1..1067: note = derived and/or modified protein sequence (wt) from RVFV(763/70)__DQ380188.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYGLTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2195 - protein, 1067 aa, synthetic construct
  REGION 1..1067: note = derived and/or modified protein sequence (wt) from RVFV(OS-1)__DQ380186.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALKVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2196 - protein, 1067 aa, synthetic construct
  REGION 1..1067: note = derived and/or modified protein sequence (wt) from RVFV(BIME-01)__KX609032.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2197 - protein, 1067 aa, synthetic construct
  REGION 1..1067: note = derived and/or modified protein sequence (wt) from RVFV(73HB1449)__DQ380211.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2198 - protein, 1067 aa, synthetic construct
  REGION 1..1067: note = derived and/or modified protein sequence (wt) from RVFV(SA01-1322)__KX096942.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGDPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2199 - protein, 1067 aa, synthetic construct
  REGION 1..1067: note = derived and/or modified protein sequence (wt) from RVFV(Sudan 2V-2007)__JQ820490.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCSVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSHASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLMAIDPFDDRREAGGESTVVNPKSGSWNFFDWFSGLMSWFGGPLKTILLICLYVALSIGLFFLLIYLGRTGLSKMWLAATKKAS

SEQ ID NO: 2200 - protein, 1067 aa, synthetic construct
  REGION 1..1067: note = derived and/or modified protein sequence (wt) from RVFV(35/74)__JF784387.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLDPLMWITVFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2201 - protein, 1067 aa, synthetic construct
  REGION 1..1067: note = derived and/or modified protein sequence (wt) from RVFV(200803169)__JF311384.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKVDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEVRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2202 - protein, 1067 aa, synthetic construct
  REGION 1..1067: note = derived and/or modified protein sequence (wt) from RVFV(2269/74)__DQ380222.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQHKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2203 - protein, 1067 aa, synthetic construct
  REGION 1..1067: note = derived and/or modified protein sequence (wt) from RVFV(SA-51 (Van Wyck))__DQ380195.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGRGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEVTDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2204 - protein, 1067 aa, synthetic construct
  REGION 1..1067: note = derived and/or modified protein sequence (wt) from RVFV(OS-8)__DQ380185.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLRIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLSGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2205 - protein, 1067 aa, synthetic construct
  REGION 1..1067: note = derived and/or modified protein sequence (wt) from RVFV(KEN07-KUR340)__EF460404.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRMLKCLKIAPRIVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2206 - protein, 1067 aa, synthetic construct
  REGION 1..1067: note = derived and/or modified protein sequence (wt) from RVFV(ANK-3837)__DQ380215.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGKLDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2207 - protein, 1067 aa, synthetic construct
  REGION 1..1067: note = derived and/or modified protein sequence (wt) from RVFV(Lunyo)__KU167026.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMVSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTRCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2208 - protein, 1067 aa, synthetic construct
  REGION 1..1067: note = derived and/or modified protein sequence (wt) from RVFV(200803167)__JF311382.1__Gn-Gc
MAGIAMTVLPALAVFALAPVVFAEDLHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEIALKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTMLLICLYVALSIGLFFLLIYLGRTGLSKMWLAATKKAS

SEQ ID NO: 2209 - protein, 1067 aa, synthetic construct
  REGION 1..1067: note = derived and/or modified protein sequence (wt) from RVFV(2373/74)__DQ380194.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKMVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTLDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2210 - protein, 1067 aa, synthetic construct
  REGION 1..1067: note = derived and/or modified protein sequence (wt) from RVFV(Kenya 57 (Rintoul))__DQ380192.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEISRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2211 - protein, 1067 aa, synthetic construct
  REGION 1..1067: note = derived and/or modified protein sequence (wt) from RVFV(RVFBJ01/2016)__KX785331.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2212 - protein, 1067 aa, synthetic construct
  REGION 1..1067: note = derived and/or modified protein sequence (wt) from RVFV(clone 13)__DQ380213.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2213 - protein, 1067 aa, synthetic construct
  REGION 1..1067: note = derived and/or modified protein sequence (wt) from RVFV__JQ068143.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTIDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2214 - protein, 1067 aa, synthetic construct
  REGION 1..1067: note = derived and/or modified protein sequence (wt) from RVFV(SA-75)__DQ380189.1__Gn-Gc
MARIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITVFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2215 - protein, 1067 aa, synthetic construct
  REGION 1..1067: note = derived and/or modified protein sequence (wt) from RVFV(ANK-6087)__DQ380216.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGKLDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECSTNLIDPFVVFKRGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2216 - protein, 1067 aa, synthetic construct
  REGION 1..1067: note = derived and/or modified protein sequence (wt) from RVFV(KEN/Kil-006/07)__HM586966.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2217 - protein, 1067 aa, synthetic construct
  REGION 1..1067: note = derived and/or modified protein sequence (wt) from RVFV(MgH824)__DQ380210.1__Gn-Gc
MAGIAMTVLPALAVFALAPVVFAEDPHLRNRPGKGYNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFERKGQYKGTMDSGQTKRELKSFDISQCPKIGGHGSKKCTGDAAFCSAYECTTQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVDTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFPEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2218 - protein, 1067 aa, synthetic construct
  REGION 1..1067: note = derived and/or modified protein sequence (wt) from RVFV(KEN/Mal-032/07)__HM586967.1__Gn-Gc
MAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2219 - protein, 1067 aa, synthetic construct
  REGION 1..1067: note = derived and/or modified protein sequence (wt) from RVFV(Kenya 56 (IB8))__DQ380190.1__Gn-Gc
MAGIAMTVLPALAVFALAPVVFAEDPHLRNRPGKGHNYIDGMTQGDATCKPVTYAGACSSFDVLLEKGKFPLFQSYAHHRTLLEAVHDTIIAKADPPSCDLQSAHGNPCMKEKLVMKTHCPKDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKRPLCVGYERVVVKRELSAKPIQRVEPCTTCITKCEPHGLVVRSTGFKISSAVACASGVCVTGSQSPSTEITLKYPGMSQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQPALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVAFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2220 - protein, 1067 aa, synthetic construct
  REGION 1..1067: note = derived and/or modified protein sequence (wt) from RVFV(KEN/Gar-008/06)__HM586965.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNLKVDFVGAAVSCDAAFLNLTGCYSCNAGARVCLSITSTGTGTLSAHNKDGSLHIVLPSENGTKDQCQILHFTVPEVKEEFMYSCDGDERALLMKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2221 - protein, 1067 aa, synthetic construct
  REGION 1..1067: note = derived and/or modified protein sequence (wt) from RVFV(KEN/Bar-035/07)__HM586969.1__Gn-Gc
MAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRARSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2222 - protein, 1067 aa, synthetic construct
  REGION 1..1067: note = derived and/or modified protein sequence (wt) from RVFV(Smithburn)__DQ380193.1__Gn-Gc
MAGIAMTVFPALVVFALAPVVFAEDPHLRNRPGKGHNYIDGMTQEDATCKPVTYAGACSSFDVLLEKGKFPLFQSYAHHRTLLEAVHDIIIAKADPPSCNLQSAHGNPCMKEKLVMKTYCPNDYQSAHYLNNDGKMASVKCPPKHELTEDCNFCRQMTGASLKEGSYPLQDLFCQSSEDDGSKLKTKMKGVCEVGVQVLKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTAFSAFVVVFVFSSVVIICLAILYKVLKCLKIAPRKVLNPLMWITAFIRWVYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFFLIYLGRTGLSKMWLAATKKAS

SEQ ID NO: 2223 - protein, 1067 aa, synthetic construct
  REGION 1..1067: note = derived and/or modified protein sequence (wt) from RVFV(Beijing-01)__KX611606.1__Gn-Gc
MAGIAMTVLPALAVFALAPVVFAEDPHLRNRPGKGHNYIDGVTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGRLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVFDCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASACSELIQASSRITTCSTEGVNTKCRLSGTALIRAGSVGAEACLMFEGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2224 - protein, 1067 aa, synthetic construct
  REGION 1..1067: note = derived and/or modified protein sequence (wt) from RVFV(KEN/Bar-032/07)__HM586968.1__Gn-Gc
MAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSVGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSHTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2225 - protein, 1067 aa, synthetic construct
  REGION 1..1067: note = derived and/or modified protein sequence (wt) from RVFV(TAN/Dod-002/07)__HM586971.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGRKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAQAWIISQWHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2226 - protein, 1067 aa, synthetic construct
  REGION 1..1067: note = derived and/or modified protein sequence (wt) from RVFV(KEN/Gar-004/06)__HM586964.1__Gn-Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSQKVYLDKLDLKTEENLLPDSFVCFEHKGQYKGTMDSGQTKRELKSFDISQCPKIGGHGRKKRTGDAAFCSAYECTAQYANAYCSRANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINNQSHSALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2227 - protein, 560 aa, synthetic construct
  REGION 1..560: note = derived and/or modified protein sequence (wt) from RVFV(ZH-548)__DQ380206.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2228 - protein, 560 aa, synthetic construct
  REGION 1..560: note = derived and/or modified protein sequence (wt) from RVFV(MP-12)__DQ380208.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2229 - protein, 560 aa, synthetic construct
  REGION 1..560: note = derived and/or modified protein sequence (wt) from RVFV(MP12)__Z30318.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHHLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVAHNINQVNREIGWMEGGQLVLGNPAPIPRHAPIPRYSTYLMLLLIVSYASA

SEQ ID NO: 2230 - protein, 560 aa, synthetic construct
  REGION 1..560: note = derived and/or modified protein sequence (wt) from RVFV(2007001811)__EU574040.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2231 - protein, 560 aa, synthetic construct
  REGION 1..560: note = derived and/or modified protein sequence (wt) from RVFV(2250/74)__DQ380209.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2232 - protein, 560 aa, synthetic construct
  REGION 1..560: note = derived and/or modified protein sequence (wt) from RVFV(T1)__DQ380201.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2233 - protein, 560 aa, synthetic construct
  REGION 1..560: note = derived and/or modified protein sequence (wt) from RVFV(Ken 199800523)__KU978777.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2234 - protein, 560 aa, synthetic construct
  REGION 1..560: note = derived and/or modified protein sequence (wt) from RVFV(1853/78)__DQ380220.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2235 - protein, 560 aa, synthetic construct
  REGION 1..560: note = derived and/or modified protein sequence (wt) from RVFV(73HB1449)__DQ380211.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2236 - protein, 560 aa, synthetic construct
  REGION 1..560: note = derived and/or modified protein sequence (wt) from RVFV(2007000234)__JF326191.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2237 - protein, 560 aa, synthetic construct
  REGION 1..560: note = derived and/or modified protein sequence (wt) from RVFV(73HB1230)__DQ380221.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKKELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2238 - protein, 560 aa, synthetic construct
  REGION 1..560: note = derived and/or modified protein sequence (wt) from RVFV(ZM-657)__DQ380204.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYAKAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2239 - protein, 560 aa, synthetic construct
  REGION 1..560: note = derived and/or modified protein sequence (wt) from RVFV(Kenya 83 (21445))__DQ380198.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2240 - protein, 560 aa, synthetic construct
  REGION 1..560: note = derived and/or modified protein sequence (wt) from RVFV(SAUDI 200010901)__KU978778.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIISYASA

SEQ ID NO: 2241 - protein, 560 aa, synthetic construct
  REGION 1..560: note = derived and/or modified protein sequence (wt) from RVFV(2007004194)__EU574031.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLSNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2242 - protein, 560 aa, synthetic construct
  REGION 1..560: note = derived and/or modified protein sequence (wt) from RVFV(ZH-501-777)__DQ380202.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDPGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2243 - protein, 560 aa, synthetic construct
  REGION 1..560: note = derived and/or modified protein sequence (wt) from RVFV(ZC-3349)__DQ380207.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQAVSSKIVAHCPPQDPCLVHGCIVCAHGLINYQCHTALSAFVVVFVFSSIAIICLAILYRVLKCLKIAPRKVLNPLMWITAFIRWIYKKMVARVADNINHVNREIGWMEGGQLVLGNPAPIPRHAPIPRYSTYLMLLLIVSYASA

SEQ ID NO: 2244 - protein, 560 aa, synthetic construct
  REGION 1..560: note = derived and/or modified protein sequence (wt) from RVFV(200803166)__JF311381.1__Gn
MAGIAMTVLPALAVFALAPVVFAEDPHLRNRPGKGHNYIDGMTQEDATCKPVTYAGACSSFDVLLKKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYATA

SEQ ID NO: 2245 - protein, 560 aa, synthetic construct
  REGION 1..560: note = derived and/or modified protein sequence (wt) from RVFV(1260/78)__DQ380214.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILHRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2246 - protein, 560 aa, synthetic construct
  REGION 1..560: note = derived and/or modified protein sequence (wt) from RVFV(T-46 (228113))__DQ380199.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTKDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2247 - protein, 560 aa, synthetic construct
  REGION 1..560: note = derived and/or modified protein sequence (wt) from RVFV(ZINGA J83 R1)__KU978776.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRLMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASA

SEQ ID NO: 2248 - protein, 560 aa, synthetic construct
  REGION 1..560: note = derived and/or modified protein sequence (wt) from RVFV(clone 13)__DQ380213.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQNPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2249 - protein, 560 aa, synthetic construct
  REGION 1..560: note = derived and/or modified protein sequence (wt) from RVFV(SA01-1322)__KX096942.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAFCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGDPAPIPRHAPIPRYSTYLMLLLIISYASA

SEQ ID NO: 2250 - protein, 560 aa, synthetic construct
  REGION 1..560: note = derived and/or modified protein sequence (wt) from RVFV(25010-24)__KM210509.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLIVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASA

SEQ ID NO: 2251 - protein, 560 aa, synthetic construct
  REGION 1..560: note = derived and/or modified protein sequence (wt) from RVFV(200803162)__JF311377.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCIAKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVIFVFSSTAIICLAVLYRVLKCLKIAPRKVLNPLMWITAFIRWVYKKMVARVADNINQVNREIGWMEGGQLALRNPAPIPRHAPIPRYSTYLMLLLIVSYASA

SEQ ID NO: 2252 - protein, 560 aa, synthetic construct
  REGION 1..560: note = derived and/or modified protein sequence (wt) from RVFV(2007002476)__EU574036.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIKWVYKKMVARVADNINQVNREIGWMEGGQLALGNPAPIPRHAPIPRYSTYLMLLLIVSYASA

SEQ ID NO: 2253 - protein, 560 aa, synthetic construct
  REGION 1..560: note = derived and/or modified protein sequence (wt) from RVFV(Hv-B375)__DQ380218.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKNELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2254 - protein, 560 aa, synthetic construct
  REGION 1..560: note = derived and/or modified protein sequence (wt) from RVFV(OS-1)__DQ380186.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2255 - protein, 560 aa, synthetic construct
  REGION 1..560: note = derived and/or modified protein sequence (wt) from RVFV(2373/74)__DQ380194.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKMVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2256 - protein, 560 aa, synthetic construct
  REGION 1..560: note = derived and/or modified protein sequence (wt) from RVFV(Kenya 57 (Rintoul))__DQ380192.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2257 - protein, 560 aa, synthetic construct
  REGION 1..560: note = derived and/or modified protein sequence (wt) from RVFV(Sudan 2V-2007)__JQ820490.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCSVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSHASA

SEQ ID NO: 2258 - protein, 560 aa, synthetic construct
  REGION 1..560: note = derived and/or modified protein sequence (wt) from RVFV(200803167)__JF311382.1__Gn
MAGIAMTVLPALAVFALAPVVFAEDLHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEIALKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2259 - protein, 560 aa, synthetic construct
  REGION 1..560: note = derived and/or modified protein sequence (wt) from RVFV(KEN/Gar-008/06)__HM586965.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2260 - protein, 560 aa, synthetic construct
  REGION 1..560: note = derived and/or modified protein sequence (wt) from RVFV(ANK-6087)__DQ380216.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGKLDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWVYRKMVARVADNINQVNREIGWMEGGQLVLGNPAPIPRHVPIPRYSTYLMLLLIVSYASA

SEQ ID NO: 2261 - protein, 560 aa, synthetic construct
  REGION 1..560: note = derived and/or modified protein sequence (wt) from RVFV(763/70)__DQ380188.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYGLTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2262 - protein, 560 aa, synthetic construct
  REGION 1..560: note = derived and/or modified protein sequence (wt) from RVFV(BIME-01)__KX609032.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASA

SEQ ID NO: 2263 - protein, 560 aa, synthetic construct
  REGION 1..560: note = derived and/or modified protein sequence (wt) from RVFV(KEN07-KUR340)__EF460404.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRMLKCLKIAPRIVLNPLMWITAFIRWVYKKMVARVADNINQVNREIGWMEGGQLALGNPAPIPRHAPIPRYSTYLMLLLIVSYASA

SEQ ID NO: 2264 - protein, 560 aa, synthetic construct
  REGION 1..560: note = derived and/or modified protein sequence (wt) from RVFV(SA-51 (Van Wyck))__DQ380195.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGRGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2265 - protein, 560 aa, synthetic construct
  REGION 1..560: note = derived and/or modified protein sequence (wt) from RVFV(Lunyo)__KU167026.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMVSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2266 - protein, 560 aa, synthetic construct
  REGION 1..560: note = derived and/or modified protein sequence (wt) from RVFV(2269/74)__DQ380222.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQHKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPKKVLNPLMWITAFIRWVYKKMVARVADNINQVNREIGWMEGGQLALGNPAPIPRHAPIPRYSTYLMLLLIVSYASA

SEQ ID NO: 2267 - protein, 560 aa, synthetic construct
  REGION 1..560: note = derived and/or modified protein sequence (wt) from RVFV(MgH824)__DQ380210.1__Gn
MAGIAMTVLPALAVFALAPVVFAEDPHLRNRPGKGYNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFERKGQYKGTMDSGQTKRELKSFDISQCPKIGGHGSKKCTGDAAFCSAYECTTQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 2268 - protein, 560 aa, synthetic construct
  REGION 1..560: note = derived and/or modified protein sequence (wt) from RVFV__JQ068143.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTIDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASA

SEQ ID NO: 2269 - protein, 560 aa, synthetic construct
  REGION 1..560: note = derived and/or modified protein sequence (wt) from RVFV(RVFBJ01/2016)__KX785331.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKHELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASA

SEQ ID NO: 2270 - protein, 560 aa, synthetic construct
  REGION 1..560: note = derived and/or modified protein sequence (wt) from RVFV(KEN/Kil-006/07)__HM586966.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2271 - protein, 560 aa, synthetic construct
  REGION 1..560: note = derived and/or modified protein sequence (wt) from RVFV(SA-75)__DQ380189.1__Gn
MARIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITVFIRWVYKKMVARVADNINQVNREIGWMEGGQLALGNPAPIPRHAPIPRYSTYLMLLLIVSYASA

SEQ ID NO: 2272 - protein, 560 aa, synthetic construct
  REGION 1..560: note = derived and/or modified protein sequence (wt) from RVFV(35/74)__JF784387.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGVVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSVAIICLAILYKVLKCLKIAPRKVLDPLMWITVFIRWVYKKMVARVADNINQVNREIGWMEGGQLALGNPAPIPRHAPIPRYSTYLMLLLIVSYASA

SEQ ID NO: 2273 - protein, 560 aa, synthetic construct
  REGION 1..560: note = derived and/or modified protein sequence (wt) from RVFV__M11157.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYGLTEDCNFCRQMTGASLKKGSYPLQDLFCQSSEDDGSKLKTKMKGVCEVGVQAHKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVVFVFSSIAIICLAVLYRVLKCLKIAPRKVLNPLMWITAFIRWIYKKMVARVAHNINQVNREIGWMEGGQLVLGNPAPIPRHAPIPRYSTYLMLLLIVSYASA

SEQ ID NO: 2274 - protein, 560 aa, synthetic construct
  REGION 1..560: note = derived and/or modified protein sequence (wt) from RVFV(KEN/Bar-035/07)__HM586969.1__Gn
MAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2275 - protein, 560 aa, synthetic construct
  REGION 1..560: note = derived and/or modified protein sequence (wt) from RVFV(Kenya 56 (IB8))__DQ380190.1__Gn
MAGIAMTVLPALAVFALAPVVFAEDPHLRNRPGKGHNYIDGMTQGDATCKPVTYAGACSSFDVLLEKGKFPLFQSYAHHRTLLEAVHDTIIAKADPPSCDLQSAHGNPCMKEKLVMKTHCPKDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKRPLCVGYERVVVKRELSAKPIQRVEPCTTCITKCEPHGLVVRSTGFKISSAVACASGVCVTGSQSPSTEITLKYPGMSQSSGGDIGVHMAHDDQSVSSKIVAHCPPQDPCLVHGCIVCAHGLINYQCHTALSAFVVVFVFSSVAIICLAILYKVLKCLKIAPRKVLNPLMWITAFIRWVYKKMVARVADNINQVNREIGWMEGGQPALGNPAPIPRHAPIPRYSTYLMLLLIVSYASA

SEQ ID NO: 2276 - protein, 560 aa, synthetic construct
  REGION 1..560: note = derived and/or modified protein sequence (wt) from RVFV(KEN/Bar-032/07)__HM586968.1__Gn
MAGIAMTVLPALAVFALAPVVFAEDPHLRNRPGKGHNYIDGRLQEDATCKPVTYAGACSSFDVLLEKGKFPLFQSYAHHRTLLEAVHDTIIAKADPPSCDLQSADGNKCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSVGDIGVHMAHDDQSVSSKIVAHCPPQDPCLVHGCIVCAHGLINYQCHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2277 - protein, 560 aa, synthetic construct
  REGION 1..560: note = derived and/or modified protein sequence (wt) from RVFV(Beijing-01)__KX611606.1__Gn
MAGIAMTVLPALAVFALAPVVFAEDPHLRNRPGKGHNYIDGVTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGRLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVFDCPPQDPCLVHGCIVCAHGLINYQCHTALSAFVVVFVFSSVAIICLAILYKVLRCLKIAPKKVLNPLMWITAFIRWVYKKMVARVADNINQVNREIGWMEGGQLALGNPAPIPRHAPIPRYSTYLMLLLIISYASA

SEQ ID NO: 2278 - protein, 560 aa, synthetic construct
  REGION 1..560: note = derived and/or modified protein sequence (wt) from RVFV(Smithburn)__DQ380193.1__Gn
MAGIAMTVFPALVVFALAPVVFAEDPHLRNRPGKGHNYIDGMTQEDATCKPVTYAGACSSFDVLLEKGKFPLFQSYAHHRTLLEAVHDIIIAKADPPSCNLQSAHGNPCMKEKLVMKTYCPNDYQSAHYLNNDGKMASVKCPPKHELTEDCNFCRQMTGASLKEGSYPLQDLFCQSSEDDGSKLKTKMKGVCEVGVQVLKKCDGQLSTAHEVVPFAVFKNSKKVYLDKLDLKTEENLLPDSFVCFEHKGQYKGTMDSGQIKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINYQCHTAFSAFVVVFVFSSVVIICLAILYKVLKCLKIAPRKVLNPLMWITAFIRWVYKKMVARVADNINQVNREIGWMEGGQLVLGNPAPIPRHAPIPRYSTYLMLLLIVSYASA

SEQ ID NO: 2279 - protein, 560 aa, synthetic construct
  REGION 1..560: note = derived and/or modified protein sequence (wt) from RVFV(TAN/Dod-002/07)__HM586971.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGRKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAQAWIISQWHTALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2280 - protein, 560 aa, synthetic construct
  REGION 1..560: note = derived and/or modified protein sequence (wt) from RVFV(KEN/Gar-004/06)__HM586964.1__Gn
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLQSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSQKVYLDKLDLKTEENLLPDSFVCFEHKGQYKGTMDSGQTKRELKSFDISQCPKIGGHGRKKRTGDAAFCSAYECTAQYANAYCSRANGSGIVQIQVSRVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHGCIVCAHGLINNQSHSALSAFVVIFVFSSTAIICLAVLYRVLKCLKIAPRKVLNPLMWITAFIRWVYKKMVARVADNINQVNREIGWMEGGQLALGNPAPIPRHAPIPRYSTYLMLLLIVSYASA

SEQ ID NO: 2281 - protein, 507 aa, synthetic construct
  REGION 1..507: note = derived and/or modified protein sequence (wt) from RVFV(ZH-548)__DQ380206.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2282 - protein, 507 aa, synthetic construct
  REGION 1..507: note = derived and/or modified protein sequence (wt) from RVFV(35/74)__JF784387.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2283 - protein, 507 aa, synthetic construct
  REGION 1..507: note = derived and/or modified protein sequence (wt) from RVFV(200803162)__JF311377.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2284 - protein, 507 aa, synthetic construct
  REGION 1..507: note = derived and/or modified protein sequence (wt) from RVFV(200803166)__JF311381.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHVVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2285 - protein, 507 aa, synthetic construct
  REGION 1..507: note = derived and/or modified protein sequence (wt) from RVFV(SA-51 (Van Wyck))__DQ380195.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEVTDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2286 - protein, 507 aa, synthetic construct
  REGION 1..507: note = derived and/or modified protein sequence (wt) from RVFV(ZINGA J83 R1)__KU978776.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2287 - protein, 507 aa, synthetic construct
  REGION 1..507: note = derived and/or modified protein sequence (wt) from RVFV(Entebbe)__DQ380191.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2288 - protein, 507 aa, synthetic construct
  REGION 1..507: note = derived and/or modified protein sequence (wt) from RVFV(Sudan 2V-2007)__JQ820490.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLMAIDPFDDRREAGGESTVVNPKSGSWNFFDWFSGLMSWFGGPLKTILLICLYVALSIGLFFLLIYLGRTGLSKMWLAATKKAS

SEQ ID NO: 2289 - protein, 507 aa, synthetic construct
  REGION 1..507: note = derived and/or modified protein sequence (wt) from RVFV(Sudan 86-2010)__JQ820489.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVIFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2290 - protein, 507 aa, synthetic construct
  REGION 1..507: note = derived and/or modified protein sequence (wt) from RVFV(Kenya 56 (IB8))__DQ380190.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVAFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2291 - protein, 507 aa, synthetic construct
  REGION 1..507: note = derived and/or modified protein sequence (wt) from RVFV(ARD-38388)__DQ380187.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFIGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSILSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2292 - protein, 507 aa, synthetic construct
  REGION 1..507: note = derived and/or modified protein sequence (wt) from RVFV(Sudan 28-2010)__JQ820491.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVVLSIGLFFLLIYLGRTGLSKMWLAATKKAS

SEQ ID NO: 2293 - protein, 507 aa, synthetic construct
  REGION 1..507: note = derived and/or modified protein sequence (wt) from RVFV(200803167)__JF311382.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTMLLICLYVALSIGLFFLLIYLGRTGLSKMWLAATKKAS

SEQ ID NO: 2294 - protein, 507 aa, synthetic construct
  REGION 1..507: note = derived and/or modified protein sequence (wt) from RVFV(73HB1230)__DQ380221.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTIMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2295 - protein, 507 aa, synthetic construct
  REGION 1..507: note = derived and/or modified protein sequence (wt) from RVFV(2250/74)__DQ380209.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGAKVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2296 - protein, 507 aa, synthetic construct
  REGION 1..507: note = derived and/or modified protein sequence (wt) from RVFV(SAUDI 200010901)__KU978778.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2297 - protein, 507 aa, synthetic construct
  REGION 1..507: note = derived and/or modified protein sequence (wt) from RVFV(Lunyo)__KU167026.1__Gc
CSELIQASSRITTCSTEGVNTRCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2298 - protein, 507 aa, synthetic construct
  REGION 1..507: note = derived and/or modified protein sequence (wt) from RVFV(25010-24)__KM210509.1__Gc
CSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2299 - protein, 507 aa, synthetic construct
  REGION 1..507: note = derived and/or modified protein sequence (wt) from RVFV(2007000253)__JF326192.1__Gc
CSELIQASSRITTCSTEGVNTKCRLSGTALIRAGSAGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2300 - protein, 507 aa, synthetic construct
  REGION 1..507: note = derived and/or modified protein sequence (wt) from RVFV(ZC-3349)__DQ380207.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLKAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2301 - protein, 507 aa, synthetic construct
  REGION 1..507: note = derived and/or modified protein sequence (wt) from RVFV(OS-1)__DQ380186.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALKVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2302 - protein, 507 aa, synthetic construct
  REGION 1..507: note = derived and/or modified protein sequence (wt) from RVFV(KEN/Gar-004/06)__HM586964.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2303 - protein, 507 aa, synthetic construct
  REGION 1..507: note = derived and/or modified protein sequence (wt) from RVFV(Smithburn)__DQ380193.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFFLIYLGRTGLSKMWLAATKKAS

SEQ ID NO: 2304 - protein, 507 aa, synthetic construct
  REGION 1..507: note = derived and/or modified protein sequence (wt) from RVFV(2008/00101)__HE687306.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTTLLICLYVALSIGLFFLLIYLGRTGLSKMWLAATKKAS

SEQ ID NO: 2305 - protein, 507 aa, synthetic construct
  REGION 1..507: note = derived and/or modified protein sequence (wt) from RVFV(2007001292)__EU574046.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNLFDWFSGLMSWFGGPLKTILLICLYVALSIGLFFLLIYLGRTGLSKMWLAATKKAS

SEQ ID NO: 2306 - protein, 507 aa, synthetic construct
  REGION 1..507: note = derived and/or modified protein sequence (wt) from RVFV(2007002445)__EU574037.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNEKTFAASKGNRGVQAFSKGSIQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2307 - protein, 507 aa, synthetic construct
  REGION 1..507: note = derived and/or modified protein sequence (wt) from RVFV(Ken 199800523)__KU978777.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLNAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKEGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2308 - protein, 507 aa, synthetic construct
  REGION 1..507: note = derived and/or modified protein sequence (wt) from RVFV(clone 13)__DQ380213.1__Gc
CSELIQASSRITTCSTEGVNTKCRLSGTALIRAGSVGAEACLMLKGVKDDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2309 - protein, 507 aa, synthetic construct
  REGION 1..507: note = derived and/or modified protein sequence (wt) from RVFV(2373/74)__DQ380194.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTLDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2310 - protein, 507 aa, synthetic construct
  REGION 1..507: note = derived and/or modified protein sequence (wt) from RVFV(OS-8)__DQ380185.1__Gc
CSELIQASSRITTCSTEGVNTKCRLSGTALIRAGSVGAEACLMLKGVKEDQTKFLRIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLSGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2311 - protein, 507 aa, synthetic construct
  REGION 1..507: note = derived and/or modified protein sequence (wt) from RVFV(KEN/Bar-035/07)__HM586969.1__Gc
CSELIQASSRITTCSTEGVNTKCRLSGTALIRARSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2312 - protein, 507 aa, synthetic construct
  REGION 1..507: note = derived and/or modified protein sequence (wt) from RVFV(MgH824)__DQ380210.1__Gc
CSELIQASSRITTCSTEGVDTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFPEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2313 - protein, 507 aa, synthetic construct
  REGION 1..507: note = derived and/or modified protein sequence (wt) from RVFV(200803169)__JF311384.1__Gc
CSELIQASSRITTCSTEGVNTKCRLSGTALIRAGSVGAEACLMLKGVKVDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEVRCNSESSVLSAHESCLRAPNLVSYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2314 - protein, 507 aa, synthetic construct
  REGION 1..507: note = derived and/or modified protein sequence (wt) from RVFV(2007001811)__EU574040.1__Gc
CSELIQASSRITTCSTEGVNTKCRLSGTALIRAGSVGAEACLMLKGVKEDQTKFLMIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNEKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2315 - protein, 507 aa, synthetic construct
  REGION 1..507: note = derived and/or modified protein sequence (wt) from RVFV(Kenya 57 (Rintoul))__DQ380192.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTVDLGASSSRFTNWGSVSLSLDAEGISGSNSFSFIESPGKGYAIVDEPFSEISRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2316 - protein, 507 aa, synthetic construct
  REGION 1..507: note = derived and/or modified protein sequence (wt) from RVFV(Beijing-01)__KX611606.1__Gc
CSELIQASSRITTCSTEGVNTKCRLSGTALIRAGSVGAEACLMFEGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2317 - protein, 507 aa, synthetic construct
  REGION 1..507: note = derived and/or modified protein sequence (wt) from RVFV(ANK-6087)__DQ380216.1__Gc
CSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECSTNLIDPFVVFKRGSLPQTRNDKTFAASKGNRGVQAFSKGSVQADLTLMFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVRGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2318 - protein, 507 aa, synthetic construct
  REGION 1..507: note = derived and/or modified protein sequence (wt) from RVFV(MP12)__Z30318.1__Gc
CSELIQASSRITTCSTEGVNTKCRLSGTALIRAGSVGAEACLMLKGVKEDQTKFLKLKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGGTGLSKMWLAATKKAS

SEQ ID NO: 2319 - protein, 507 aa, synthetic construct
  REGION 1..507: note = derived and/or modified protein sequence (wt) from RVFV(KEN/Bar-032/07)__HM586968.1__Gc
CSELIQASSRITTCSTEGVNTKCRLSHTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLVSYKPMIDQLECTTNLIDPFVVFERGSLPQTRNDKTFAASKGNRGVQAFSKGSVQADLTLRFDNFEVDFVGAAVSCDAAFLNLTGCYSCNAGARVCLSITSTGTGTLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 2320 - protein, 1339 aa, synthetic construct
  REGION 1..1339: note = derived and/or modified protein sequence (wt) from SFNV(Toscana)__NC_006320.1__GP
MFIAKLLLISCLVQQAYLKYTIISEIGNGTRTSFCYSSRTSLGSLLEAWDNITESIGLTSGTCKVGSLENRDCKRDIMSNYVAEVHSNLHGLGAMMHNYGDDKRVEVLNDVIPDELNPGRHNCSDLDRKPFWTEFINVAKPANKIAPISVIPPPIVKPIPIAESTIKKTIPFDKLLSEAEKELNQTKIRLETERRSNAEEAARERARMREIEDKLRKNWELERERKDAVADDLAKEIARRREIERKAHELDKMLKKKEREDQVAIERVSEDMRNHVRRPNTTIAPAPTIITTLLMASAVMAGPLENRETNHLLNRPGNGAYTLSDFAESTCTLAYGSKCKSWEHQLDELSFPFFHSNLDKYSMLEAATETIPILNKSSAVCTISPSTHSSNACGREASLIKKKCGNNMSAFFYVNLAGQITVVKCDTNHVLSNDCGNCISKTLSGQKIYTPVQDMFCQRGWTESIPSTRYSKDLCSIGLHTVKECKTGTTNFERVGFIVVKSRKMYIEQMKMRSRQEFSEDQFLCYKSESSSGSSVKLKKVKVESCKGVTTSSASKCSGDEYFCSRYPCETANVEAHCILRRHSAVIEVNVNGVWVVPRCIGYEEVLVRRTSLKMEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKKLFYWLITPLCWLSVFCGWMIKSWKKKVGSAISRTNDTIGWRDNRRYGRDVERAQYTGGAPGAKYSFYGVMILGLLGNVHSCSESVIADSKVMQCTTSGSSTLCKASGTVIMKLGPIGSESCLILKGLKDNEKQFISIKTISSELTCREGESFWTTLYTPVCLSSRRCHLMGECCSDRCLKWKTNETSAEFTGKAHGEVMHENRCFEQSGGIGYGCFNVNPSCLYVHSILKSVYKNGFKIFRCVAWNHRIRLEVTTHSRKFPMVLMAMSTQPTDWGSIGLILDSEGITGTNAYSFMKHGSGSLAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYHNSQSDCSATFKNLTGCYSCDEGSRMCYQVKAEGETIFHFVNEDESINVINKVSPDVSDYCTVLHFSRPVISIEGRYDCGLSKSPMVIKGTLIATAPHDDRKHEGGSSLVVNPKGGTVDFFGWVSGLTSWLGGPLKTFLTILGFLALGLLLVVIIITIARTGVEQALKKKNK

SEQ ID NO: 2321 - protein, 1323 aa, synthetic construct
  REGION 1..1323: note = derived and/or modified protein sequence (wt) from SFNV__HM566171.1__GP
MLNTKSIILITCLVQQVHLKYTIISEVTKGAREVSCYSSTTRLDQLLEAWENKSALMGLRKGNCKLGAMEQVDCNLDLMSNYVSNVYDNPHGLGAMMYNDKRIEVLNDQIPDSMIPGGHNCSLLERKPFWADLIPSKKENPRPSLISLVPTPRSDFKRKFEEAEEEMKKIRKELQDERQAQLSVIEEGRKRMRDLEDKLMRQWNEEKQKKGLLEETLEKKRQLKNKALLDAHNLDKQLKEKDREFKTAMEEHQNERHRINSNMIRPPITTPAAVILTSLLSASVVLGFELENRNTNHALNRPGNGGYSISDNNLIEAKCMITYGNKCPSWEMQLDPVSYPFFSSNFEKYSLLESISETSPIIGKFSEVCVLSNLPGAQKTCAKEASLIKKQCSDDMRAYFYINSLGKLAIVTCPENNVLSQDCNFCLRKAKGEQYVYKPIQDGFCQNGGVSSVPSIRYSKDICSIGPTKVKNCHKGTSRYERTAFISTGDKKVYLEEIKIRSRQEYEPDQFLCYKVKDSSSSPLAYEKVQVSKCKGIETNSPKKCTGDEYFCSKYPCESTSPEANCFLRKHSAILEVNIGGMWIKPKCIGYEMALVKRVGLRSEDVSSKECATCLWECSSGYISITTHGPKISYATACSHGSCKSIVQNPSTSIRISYPGNSEIVGGDIGIHLTEDSSPINLHLKIHCSPKDSCEVSDCIFCVHGLLNYQCHSVASALLLSTITASLIVLMIYMLSKTKFVMKKLIPIMLTPLCWCFVLLAWLTKSWKGKMRNAIQSANSTIGWTEREERIVAERPRSRNTVRYSFYGVVILAMLESAFGCSESLIAESKVMQCNIANGKTSCRASGTIIMKLGPIGSEACLILKGLRDSDKQYISVKTESSELICREGESFWTSLYTPVCLSSRRCHLMGECTGDLCLKWKSNKTSLEFAGKTRSDVINENKCFEQSGGLGYGCFNVNPSCLYTHAYLKSVYRNGFRVFKCASWTHRVKLTITTHSRTFPMTLAAMSTQPTDWGSIGLILDSEGISGTNSFSFMKHGLGSFAIIDEPYSMEPRKGFIGEVRCPTEEAAIKASTLCKTAPQLIEYQPEMDSAECTTNMIDPMSVFNRGSLPQVREGMTFTQSMEKNTVQAMTTGEVHASIRIVLDDYEVEYLSSQVDCDATFKNLTGCYSCDEGARVCMQIIAHGDTIFHFRNPDVSINILQKVNTNTLIYCSVVHFSKPVIKEEGTYDCGAGEKPMILKGTLVAVSPHNDRLEQGGSSIVINPKGGGVDFLGWLSGFSSWFGGPLKAILMVIGFLLLGLILFVTIAIGLKFALRQMIVKRMK

SEQ ID NO: 2322 - protein, 1290 aa, synthetic construct; identical to SEQ ID NO: 2005
  REGION 1..1290: note = derived and/or modified protein sequence (wt) from SFNV(Namru)__HM566169.1__GP

SEQ ID NO: 2323 - protein, 1329 aa, synthetic construct
  REGION 1..1329: note = derived and/or modified protein sequence (wt) from SFNV/SFNV-like(Poona)__HM566177.1__GP
MLNVKSVILITCLVQQAHLKYTIISEVAKGAREVSCYSSTTRLDQLLEAWENKSALIGLKRGNCKLGAMEQINCNLDLMSNYVSNVYDNPHGLGAMMYNTDSDKRIEVLNDQIPDSMIPGGHNCSLLERKPFWADLIPPKKEKELDPKPSLISLVPTPRDDFKKKFEEAEEEMKKIRKELQNERQAQLSVMEDSRKKMRDLEDRLMRQWEEEKQKKGLLEETLEKERQLKNKALLDAHDLDKQLKERDREFKTAMEEHQNERRRINSNMIRPYVTTPAAIILTSLLSASVVVGFELENRNTNHVLNRPGNGGYSISDNNLIEAKCMITYGTKCLSWEMQLNPVSYPFFSSNFEKYSLLESVSETTPIIGKFSEVCVLSNLSGAQKTCAKEASLIKKQCPDDIRAYFYINSLGKLAIVTCPENNVLSQDCNFCVPKAKGERYIYKPIQDGFCQNGGVSTVPSVRYSKDICSIGPLKVKNCHKGTSRYERTAFISTGDKKVYLEEVKIRSRQEYEPDQFLCYKVKDGSSSPLVYEKVQVSKCKGIETNSPKKCTGDEYFCSKYPCESTSPEANCYLRKHSAIIEVNIGGMWVKPKCVGYEMALVKRVGLRSEDVSLKECATCLWECSSSYISITTHGPKISYATACSHGSCKSVVQSPSTSIKISYPGNSEIVGGDIGIHLTEDSSPVNLHLKIHCPPKDSCEVSDCILCVHGLLNYQCHSVASALLLSTIIASLIALVVYMLSKTRFVMRKIVPIMFIPFCWCFVLLAWLTRSWKGKVRNAIQSANNTIGWTEREERVIAERPGGRNTIRYSFYGVVILAILESAFGCSESLIAESKIMQCNIANGKTSCRASGTIIMKLGPIGSEACLILKGLRDSDKQYISVKTESSELICREGESFWTSLYTPVCLSSRRCHLMGECTGDLCLKWKSNKTSLEFAGKTHSEVMNENRCFEQSGGLGYGCFNINPSCLYTHAYLKSVYRNGFRVFKCASWTHRVRLTITTHSRTFPMTLAAMSTQPTDWGSIGLILDSEGISGTNSFSFMKHGLGSFAIIDEPYSMEPRKGFIGEVRCPTEEAAIKASTLCKTAPQLIEYQPEMDSVECTTNMIDPMSIFNRGSLPQVREGMTFTQSMEKNTVQAMTTGEVHASIRLVLDDYEVEYLSNQVDCDATFKNLTGCYSCDEGARVCMQIKAHGDTIFHFKNSDMSMNILQKVSTNTLIYCSVVHFSKPVIKEEGVYDCGAGEKPMILKGTLVAVSPHNDRLEQGGSSIVINPKGSGVDFLGWLSGFSSWFGGPLKAILTVIGFLLLGFLLFMLVTIGLRYALSQVVTKKMK

SEQ ID NO: 2324 - protein, 1333 aa, synthetic construct
  REGION 1..1333: note = derived and/or modified protein sequence (wt) from Arrabida virus(PoSFPhlebV/126/2008)__KP863800.1__GP
MFYAKFILLLCFVQGALLKYTIISKVGSSTYKRVCLSHTTDLDTLLDMTSREMSNIKLTGGSCSLGDLTKPDCSPDFFSNYVANIQSSNTKITGKFQDIIGEREMEVTNDVVPDSFGPGPHDCVSFDKKPFWSDLLPTSVSKEEPKPIISTLSVLPAAPPIKDFSHKVVEAEEMVKEIEGELMKEKERNSAKEEEARQRMRELEDDLRKQWAAERMAKQNMSSVLERERQEKQSLERRMHEVDKKLRASEDRAQKYQERAEQAEKSHSKLLSRSGAATTMATVVFTSLLASGLAVVTELEKRDTNHLLNRPGNGVYMANADSLIQTECTLNYGQRCLAWELQITPVRYPFFTSNVDKYSLLESITETPSILEKNNESCQLATTSGSLKTCAKEASTIKKHCTDDVRAFFFINSVGKLTIVRCADNHILSEDCNFCISKARNSNQNMFMPVQDAFCQRQGSDTAPAIRYSKDICSIGAIKIKQCHKATSKFERMGFISVGQKKLYIEELKLRYRQEYDPDQFMCYKIKSSSPLKYEKVSSKKCKEVDTGGNQKCSGDEHFCNRYPCDTANPEAHCLTRKHSAIAEVNIGGVWIRPKCVGYEMVLVKRSGLKSEDLSIRDCPSCLWECKKSRITIKTHGPKIVSATACSHGSCKSVMQKPSTFVEIPYPGNSEIIGGDIGVHMTERGSPSNIHVRTHCPPRDSCDVSDCMFCVHGILNYQCHTLASALTIATIVSAVLVVVYFLLARSKRAVKFITSLLIVPFKWLTLLSIWVVKNWKRKMSKLARATNNAIGWDQDVERGRPRAAAGHQNQVARYTFYGATILSLMTSGLCCTESVIAESNIMQCTTSDSTTTCKASGTIILRLGPIGSESCLILKGLRDSEKQFISIRTVSSELTCREGDSFWTSLYTPICLSSRRCHLMGECTGDNCLKWQDNKTSSEFTGRTHSEVLHENKCFEQSGGIGYGCFNVNPSCLMVHSYLKPIYKNAFKVFRCVAWNHRVKLAITTHKKSFDVTLMAMSTQPTDWGSIGLILDSEGITGTNSYSFMKYGVGSFAIIDEPFSIEPRKGFLGEVRCPTEETAVKASPSCKAAPQIIEYHPEMDTVECITNMMDPMAIFNRGSLPQVRDGVTFAQSIEKNSVQALTTGEIKASVRLVLDDYEVEYKVSENDCDSTFINITGCYSCDEGARLCVRIRTLGDSIYHFTDSEDMMNVMFKVNSSVTEYCTVLHFSKPVVNFEGKYDCGKSRKPMIIKGTLIAMAPHDDRVHSGGSSIVVNPKSKGVDFLGWLSGLSSWLGGPLKTVLTVLGFLILGLVFVIVVIFLVRVGIRQALLKKMK

SEQ ID NO: 2325 - protein, 1334 aa, synthetic construct
  REGION 1..1334: note = derived and/or modified protein sequence (wt) from Massilia virus(127)__KT906100.1__GP
MFYAKFVISLCLEPGFSLKYTIISKSGSGTIRQICLSHSTDIDKVLELSSGEMNTIGILGGLCTFGELKREDCSPDVFSNYVANMYGTAHPSSCKFVDITGDRSIEVLNDAVPDSFTPGAHNCSSFEKKPFWTDLIPAKNSSGAIPSVVSVLPSVAEHDFNLKVKEANDKLEVIQRELAAEKARSGRLEDEARAKMKALEDELRNGWLAEREAKELAKSALEKERINKLEVERKLHDLGKKLRQSEDDVEKMRVHHKKGRKESDEEMKIARTTAPSVSTTLATVVFTSLLATGLAAIEPIEDRNVNHILNRPGSGVYMASPTLTQNECSLDYGKECKAWELQVSPLHYPFFTSNVDKYTFLESITLLPPILLINNEFCELTTSSGPLKQCQKESSLIKKCCTEDARAYFFIDLEGKLSIVHCSNNQVLSEDCNFCVTKSGGVSHKIFMPIQDAFCQKGGSESIPVVRYSKDICSIGLSKVKSCHKSTSRYERMGFIVAGKKKLYIEDLKMRYRQEYDEDQFFCYKVNKTSPLEYGKESPSKCKGVGSNEQKCNGDEYFCNRYPCETNSPEAHCSLRRHAAVVEVYVGGAWIKPKCVGYEKVLVKRGGLKTEDLSVRECTSCLWECEKNKIVIKTHGPKIVSATACGGRSWKSVMQKPSTFLDLPYPGNSEIIGGDRGNHLSERGSPYNIHSTIHSPPEDSRDASDCIYCRHGLLNYQSHSVESAILLSTVVATILALTGVVLSRSKSAVRFLASAVAVPFRWVSLLVVWVMKKWKARVATAIRATNNAIGWDNGLEQARVENAARRQQTAGRWRSLDASTILSVLSTGLCCTESLIAESSIMQCTTGEGSTTCKATGTVVLKLGPIGSESCLILKGLRDNERQFISIKTISSELTCREGESFWTPLYTPVCLSSRRCHLMGECTGDMCLKWKSNKTSSEFTGKTHSEVIHENKCFEQSGGIGYMCFNVNPSCLMVHSYLKPIYKNAFKVFRCIAWNHRVRLGITTHKRKFEVTLMAMSTQQADWGSIGLILDSEGISGTNSYSFMKHGLGSYAIIDEPYSVEPRKGYLGEVRCPTEETAIKASPSCKVAPGLVEYQPEMDTLECTTNMMDPMAIFNRGSLPQVRGGWTFSQSIEKNSRQALNTGAINASVRHVLDEYEFDYKVKTNDCDSTFVNITGCYSCDEGARLCVKVRTSSEAIYHFTDSGYNINVLFKVESGVHDHCTILHFSKPVISIEGKYDCGKNKKPMLIKGTLIAMAPHDDRVVSGGSSTVVNPKGQGVDFLGWLSRLSSWFGGGPLKTFLMVTGFLMTGVIGGIVTIILIRIVLQQALAKKVK

SEQ ID NO: 2326 - protein, 1334 aa, synthetic construct
  REGION 1..1334: note = derived and/or modified protein sequence (wt) from Massilia virus(130)__KT906101.1__GP
MFYAKFVISLCLEPGFSLKYTIISKSGSGTIRQICLSHSTDIDKVLELSRGEMDTISILGGLCTFGELKREDCSPDVFSNYVANMYGTTHPSSCKFVDIIGDRSIEVLNDAVPDSFTPGAHNCSSFEKKPFWTDLIPAKNSSGAIPSVVSVLPSVAEHDFNLKVKEANEKLEVIQRELAAEKARSGRLEDEARAKMKALEDELRNGWLAEREAKELAKSALEKERINKLEVERKLHDLGKKLRQSEDDVEKMRVHHKKRRKESDEEMKIAKTTAPSVSTTLATVVFTSLLATGLAAIEPIEDRNVNHILNRPGSGVYMASPTLTQNECSLDYGKECKAWELQVSPLHYPFFTSNVDKYSILESITQSSPILLKNNNSCELTTSPGTQKQCQKESSTIKKYCTDDARAYFFIDLEGKLSIVHCTNNYILSEDCNFCVSKLGEVGHKIFMPIQDAFCQKGGSESIPIVRYSKDICSIGLFKIKNCHKSTSRYERMGFIVAGKKKLYIEELKMRYRQEYDEDQFFCYKVKKTSPLEYAKVSPSKCKGVGSNEQKCNGDEYFCNRYPCETNSPEAHCSLRRHAAVVEVYVGGAWIKPKCVGYEKVLVKRGGLKTEDLSVRECTSCLWECEKNKIVIKTHGPKIVSATACGHGSCKSVMQKPSTFLDLPYPGNSEIIGGDRGNHLSERGSPYNIHSTIHCPPEDSRDASDCIYCRHGLLNYQSHSVASAILLSTVVATILALTGVVLSRSKSAVRFLASAVAVPFRWVSLLVVWVMKKWKARVTTAIRATNNAIGWDNGLEQVRVENAARRQQPAVRWRSLDASTILSILGTGLCCTESLIAESSIMQCTTEEGSTTCKATGTVVLKLGPIGSESCLILKGLRDNEKQFISIKTISSELTCREGESFWTSLYTPVCLSSRRCHLMGECTGDICLKWKSNKTSSEFTGKTHSEVIHENKCFEQSGGIGYMCFNVNPSCLMVHSYLKPIYKNAFKVFRCIAWNHRVRLGITTHKRKFEITLMAMSTQQTDWGSIGLILDSEGVAGTNAYSFMKHGLGSFAIIDEPYSVEPRKGYLGEVKGPREETAIKASPSCQVAPGLVEYQPVMDTVECTTNMMDPLAIFNRGSLPQVRGGWTFSQSIEKNSLQALNTGAIHASVRHVLDEYEFEYKVKSNDCDSTFVNITGCYSCDEGARLCVKVRTSSEAIYHFTDSGYNINVLFKVDSGVHDHCTILHFSKPVISIEGKYDCGKNKKPMLIKGTLIAMAPHDDRVVSGGSSTVVNPKGQGVDFLGWLSGLSSWFGGGPLKTFLMVTGFLMTGVISGIVTIILIRIVLQQALAKKVK

SEQ ID NO: 2327 - protein, 1332 aa, synthetic construct
  REGION 1..1332: note = derived and/or modified protein sequence (wt) from Massilia virus(W)__EU725772.1__GP
MFYAKFVIILCLVQGFSLKYTIISKSGSGTIRQICLSHSTDIDKVLELSSGEMDTINIQGGLCTFGELKREDCSPDVFSNYIANMYGTTHPSSCRFLDIIGDRSIEVMNDASPDSFTPGAHNCSSFEKAPFWSDLIPAKNGSGPSPSVVSVLPSATESDFSLKVKKANERLEVIQRELAAEKARSGRLEDEARTKMRALEDELRNGWLAEREAKELAKSDLEKERVNKLEVERKLHDLNKKLRQSEDEAERLREYHNKRRKESDEKMKMTKTVAPNVSTTLATVVLTSLLATGLAAIEPIEDRNTNHILNRPGTGVYMASPTLTENDCSLDYGKECKAWELQVSPLHYPFFTSNVDKYSLLESITQASPILIKNNNSCELTTSPGSQKQCQKESSTIKKYCTDDARAYFFVDLEGNLSIVHCSNNNILSEDCNFCISKSGVTGQKIFMPIQDAFCQRGGSESLPVIRYSKDICSIGLFKIKSCHKSTSRYERMGFIVVGRKKLYLEELKMRYRQEYDEDQFYCYKAKTTSQLQYQKVSPSKCKGVGSKDQKCNGDEYFCNRFPCETNNPDAHCSLRRHAAVVEVNVGGAWVKPKCVGYEKVLVKRGGLKTEDLSVRECTSCLWECEKNKIVIKTHGPKIVSATACSHGSCKSVMQKPSTFLDLPYPGNSEIIGGDIGIHMSERGSPSNIHITIHCPPKDSCDVSDCIFCRHGILNYQCHSVASAILLSTVVATILALTGVIISRSKFAVRFLASAVAIPFRWVSLLVVWVMKKWKSRIATAIRATNNAIGWDNGLEQVRVENAARRPQPAVRYAFYATTILSILGSGLCCTESLIAESSIMQCTTEDSSTTCKATGTVVLKLGPIGSESCLILKGLRDNEKQFISIKTISSELTCREGESFWTSLYTPVCLSSRRCHLMGECTGDICLKWKSNKTSSEFTGKAHSEVIHENKCFEQSGGIGYGCFNVNPSCLMVHSYLKPIYKNAFRVFRCIAWNHRVRLGVTTHKRKFEITLMAMSTQQTDWGSIGLILDSEGIEGTNAYSFMKHGLGSFAIVDEPYSVEPRKGYLGEVRCPTEETAIKASPSCKVAPGLIEYQPEMDTVECTTNMMDPMAIFNRGSLPQVREGKTFTQSIEKNSVQALTTGEIHASVRLVLDEYEIEYKVTSNDCDSTFVNITGCYSCDEGARLCVKVKSSSEAIYHFTDSSFSVNVLFKVTPSVHDYCTILHFSRPVISIEGKYDCGKNKKPMLIKGTLIAMAPHDDRVINGGSSTVVNPKGHGVDFLGWLSGLSSWFGGPLKTFLMVMGFLMIGVIIVIVTIILIRIGLQQALAKKFK

SEQ ID NO: 2328 - protein, 1331 aa, synthetic construct
  REGION 1..1331: note = derived and/or modified protein sequence (wt) from Punique virus(PI-B4-2008)__JF920134.1__GP
MFYAKFVIILCLVQGFSLKYTIISKLGSGTTRQVCLSHSTDLDKVLEISNMEMDAINLLGGFCTLGELRREDCSPNVFSNYVVNVHGTIHSSNCKFVDIVGDRSIEVLNDATPDSFTPGAHNCSSFEKPPFWTDLVPKKNDTDPSPSLLSVLPAAAELDFNLKLKEANDKVEAIQRELVAEKARSGRIEDEARTKMRELEDELRRGWIAEREAKELAHKNLEEERVSKLEIERRMHDLDKKLRQSENDADRLREQYNKKRKSEEEVKTPKASTLNATTTLATVVLTSLLATGLAAIEQIEERNTNHILNRPGTGVYMASPTLTQTECSLGYGKECKSWELQVSPLHYPFFTSNVDKYSILESITQEPTLLIKNNNSCELTTSPGSQKQCQKESSTIKKYCTDDARAYFFIDLGGNLSIVHCSNNFVLSEDCNFCISKSGGVGQKIFMPIQDAFCQRGGSESPPVVRYSKDLCSIGLFKIKSCHKSTSRYERMGFIVAGQKKLYLEELKMRYRQEYDEDQFFCYKVKSNSPLQYEKVSPSKCKGVGSQDQKCNGDEYFCNRYPCDTNNPDAHCSLRRHAAVVEVNVGGVWIKPKCVGYEKVLVKRGGLKTEDLSVRECTSCLWECERNKVVVKTHGPKIVSATACSHGSCKSVMQKPSTFLEIPYPGNSEIIGGDIGIHMSERGSPSNIHVVVHCKPKDSCDISDCIFCKHGILNYQCHSVASAVLLSTMIAACLALVGVIVSRSKHAVKFLASVVAIPFKWVSLLTVWVVKNWKLRITRVIRATNDAIGWENNLEQVRVENAARRPQPAVRYAFYGTTILSILSTGLCCSESLIAESSIMQCTTEDSSTVCKATGTVVLKLGPIGSESCLILKGLRDNEKQFISIKTISSELTCREGESFWTSLYTPVCLSSRRCHLMGECTGDICLKWKTNKTSAEFTGKTHSEVIHENKCFEQSGGMGYGCFNVNPSCLMVHSYLKPIYKNAFKVFRCVAWNHRVRLGITTHKRNFEITLMAMSTQQTDWGSIGLILDSEGITGTNSYSFMKHGLGSFAIIDEPYVTEPRKGYLGEVRCPTEETAVKASPSCKVAPGLIEYQPEMDVVECTTNMMDPMAIFNRGSLPQVRDGKTFTQSIEKSSVQALTTGEIHASVRLVLDEYEVEYKVVNNDCDSTFVNITGCYSCDEGARLCVKVKASSDVIYHFTDSDNSMNVLFKVSSNIQDYCIVLHFSKPVVNVEGKYDCGRSKKPMLIKGTLIAMAPHDDRVTNGGSSIIINPKGGGVDFLGWLSGLSSWFGGPLKTFLIIAGFLIVGIIIVIIIIILARLGIQQALAKKLK

SEQ ID NO: 2329 - protein, 1339 aa, synthetic construct
  REGION 1..1339: note = derived and/or modified protein sequence (wt) from TOSV(9028)__KU904264.1__GP
MFIAKLLLISCLVQQAYLKYTIISEIGNGTRTSFCYSSRTSLGSLLEAWDNVTESIGLTSGTCKVGSLENRDCRKDIMSNYVAEVHSDLHGLGAMMHNYGDDKRVEILNDVIPDELNPGHHNCSDLDRKPFWTEFINVAKPLSEIVPMSVIPPPVVKLQPPAEPSSKKHVPFDVLLSEAEKELNQTKIRLEDERKSNAEETAKERARMKEIEDELRREWELERKRKDAMADDLAKETARRREIERKAHELDKMLKKKERESLIAKEKADEDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVIKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCSRYPCETANVEAHCILRRHSAIVEVNVNGVWVVPRCIGYEEVLVKRTSLKVEDTTGRECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAELTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLILDDYDVVYQNSQSDCSATFKNLTGCYSCDEGSRLCYQVKAEGETIFHFINEEESINVINKVSPGVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2330 - protein, 1339 aa, synthetic construct
  REGION 1..1339: note = derived and/or modified protein sequence (wt) from TOSV(A189)__KP694241.1__GP
MFIAKLLLISCLVQQAYLKYTIISEIGNGTRTSSCYSSRTSLGSLLEAWDNITESIGLTSGTCKVGSLENRDCKRDIMSNYVAEVHSNLHGLGAMMHNYGDDKRVEVLNDVIPDELNPGRHNCSDLDRKPFWTEFINVARPTNKMAPMSVIPPPIVKPIPVAEPTIEKTIPFDKLLSEAEKELNQTKIRLEAERRSNAEEAAKERARMREIEDKLRKDWELERERKDAVADDLAKEIARRREIERKAHELDKMLKKKEREDLVARERVSEDMRNHVRRPNTTIAPAPTIITTLLMASAVMAGPLENRETNHLLNRPGNGAYTLSDFAESTCTLAYGSECKSWEHQLDELSFPFFHSNLDKYSMLEAATETVPILNKSSAVCTIYHPRIHRMACGREASLIKKKCGSNMSAFFYVNLAGQITVVKCDTNHVLSNDCGNCISKTLSGQKIYTPVQDMFCQKGWTESIPNTRYSKDLCSIGLHTVKECKTGTTNFERVGFIVVKGRKMYIEQMKMRSRQEFSEDQFLCYKSESSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLMRGAKDLVKRLFYWLITPLCWLSVFCSWMIKSWKKRVGSAISRTNDTIGWRDNRRYGQDVERAQYTGGAPGAKYSFYGVMILGLLGNVHSCSESVLADSKIMQCTTSGSSTLCKASGTVIMKLGPIGSESCLILKGLKDSEKQFISIKTISSELTCREGESFWTTLYTPVCLSSRRCHLMGECVSDRCLKWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSEGITGTNAYSFMKHGSGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQSDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVQQALKKKNK

SEQ ID NO: 2331 - protein, 1339 aa, synthetic construct
  REGION 1..1339: note = derived and/or modified protein sequence (wt) from TOSV(AR)__EF656362.1__GP
MFIAKLLLISCLVQQAYLKYTIISEIGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPSSEIVPMSVIPPPVVKLQPPAEPSSKKHVPFDVLLSEAEKELNQTKIRLEDERKSNAEETAKERARMKEIEDELRREWELERKRKDAMADDLAKETARRREIERKAHELDRMLKKKERESLIAKEKADEDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVVKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCNRYPCETANVEAHCILRRHSAIVEVNVNGVWVVPRCIGYEEVLVKRTSLKVEDTTGRECDSCLWECGKDKLIVKTHGPKVVYATACSHGSCKSVMQKPATFVYLPYPGNSEIVGGDIGIHMTEESSPSNIHLVAHCPAKDSCDVSDCLFCVHGLLNYQCHTLFSALLISTTVMSILTLLLLLVKGAKDLVKKLFYWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWIHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETVFHFINEEESINVINKVSPGVSDYCTVLHFSRPVISIEGTYDCGLSKRPMVIKGTLIATAPHDDRKHEGGSSLVVNPKGGSVDFFGWVSGLTSWLGGPLKTFLTILGFLAVGLLLVVIIIIIIRTGMQQALKKKIK

SEQ ID NO: 2332 - protein, 1339 aa, synthetic construct
  REGION 1..1339: note = derived and/or modified protein sequence (wt) from TOSV(EsPhGR40)__FJ153283.1__GP
MFIAKLLLISCLVQQAYLKYTIISEIGNGTRTSFCYSSRTSLGSLLEAWDNVTESIGLTSGTCKVGSLENRDCGKDIMSNYVAEVHSNLHGLGAMMHNYGDDKRVEILNDVIPDELNPGHHNCSDLDRKPFWTEFINVAKPLSEIAPMSVIPPPVVKLQPPAEPSSKKHVPFDVLLSEAEKELNQTKIRLEDERKSNAEETARERARMRDIEEELRKEWELERKRKDAMADDLAKETAKRREIERKAHELDRMLKKKERESLIAKEKEDENMRSRVHKPSTTRAPAPTIITTLLMASTALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSALFYINLAGQITVVKCETNHVLSSDCGNCISKSLSGQKVYTPVQDVFCQKGWTESIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCSRYPCETANVEAHCILRRHSAIVEVNVNGVWVVPRCIGYEEVLVKRTSLKVEDTTERECDSCLWECGKNKLIVKTHGPKVVYATACSHGSCKSVMQKPTTFVYLPYPGNSEIVGGDIGIHMTEESSPSNIHLVAHCPARDSCDVSDCLFCVHGLLNYQCHTLFSALLISTTVMSILTLLLLLVKGAKDLVKKLFYWLITPLCWLSVFCCWVVKSWKRRVGSAISRTNDTIGWRENRRYAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNETSAEFTGKAHGDVMHENKCFEQSGGIGYGCFNVNPSCLYVHSYLKSVYRNGFKIFRCVAWNHRIRLEVTTQSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETVFHFINEEESINVINKVSPDVSDYCTVLHFSRPIISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2333 - protein, 1337 aa, synthetic construct
  REGION 1..1337: note = derived and/or modified protein sequence (wt) from TOSV(SI-121283)__JF330279.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPGRHNCSDLDRKPFWTEFINVAKPANEMAPMSVIPPPIVKPIPVAESTTKKTIPFDKLLSEAEKELNQTKIRLETERRSNAEEAAKERARMREIEDKLRKDWELERERKDAVAEDLAKEIARRREIERKAHELDKMLKKKEREDLVARERVDEDMRNHVRRPNTTIAPTIITTLLMGSAVMAGPLENREPTHLLNRPGNGAYPLSDFAEPTCTLAYGSECKSWEHQLDELSFPFFHSNLDKYSMLEAATETIPILNKSSAVCTISPSTHSSNACGREASLIKKKCGSDMSAFFYVNLAGQITVVKCDTNHVLSNDCGNCISKTLSGQKIYTPVQDMFCQKGWSESIPSTRYSKDLCSIGLHTVKECKIGTTNFERVGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKKRVGSAISRTNDTIGWRDNSRRGQDIERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSEGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2334 - protein, 1337 aa, synthetic construct
  REGION 1..1337: note = derived and/or modified protein sequence (wt) from TOSV(SI-121487)__JF330280.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPGRHNCSDLDRKPFWTEFINVAKPANEMAPMSVIPPPIVKPIPVAESTTKKTIPFDKLLSEAEKELNQTKIMLETERRSNAEEAAKERARMREIEDKLRKDWELERERKDAVAEDLAKEIARRREIERKAHELDKMLKKKEREDLVARERVDEDMRNHVRRPNTTIAPTIITTLLMASAVMAGPLENREINHLLNWPGNGAYTLSDFAESTCTLAYGSECKSWEHQLDELSFPFFHSNLDKYSMLEAATETIPILNKSSAVCTISPSTHSSNACGREASLIKKKCGSDMSAFFYVNLAGQITVVKCDTNHVLSNDCGNCISKTLSGQKIYTPVQDMFCQKGWSESIPSTRYSKDLCSIGLHTVKECKIGTTNFERVGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKKRVGSAISRTNDTIGWRDNSRRGQDIERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSEGITGTNAYSFMKHGSGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKSTLIATAPHDDRKHEGGSSLVVNPKGGTVDFFGWVSGLTSWLGGPLKTFLTILGFLALGLLLVVIIIIIARTGVQQALKKKNK

SEQ ID NO: 2335 - protein, 1337 aa, synthetic construct
  REGION 1..1337: note = derived and/or modified protein sequence (wt) from TOSV(SI-21137)__EU003173.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPRRHNCSDLDRKPFWTEFINVAKPANEIAPMSVIPPPIVKPIPVAESTTKKTIPFDKLLSEAEKELNQTKIRLETERRSNAEEAAKERARMREIEDKLRKDWELERERKDAVAEDLAKEIARRREIERKAHELDKMLKKKEREDLVARERVDEDMRNHVRRPNTTIAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSNMSAFFYVNLAGQITVVKCDTNHVLSNDCGNCISKTLSGQKIYTPVQDMFCQKGWSETNPSTRYSKDLCSIGLHTVKECKIGTTNFEREGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKKRVGSAISRTNDTIGWRDNSRRGQDIERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSGGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2336 - protein, 1337 aa, synthetic construct
  REGION 1..1337: note = derived and/or modified protein sequence (wt) from TOSV(SI-31051)__EU003174.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPGRHNCSDLDRKPFCTEFINVAKPANEMAPMSVIPPPIVKPIPVAEPTTKKTIPFDKLLSEAEKELNQTKIRLETERRSNAEEAAKERARMREIEDKLRKDWELERERKDAVAEDLAKEIARRREIERKAHELDKMLKKKEREDLVARERVDEDMRNHVRRPNTTIAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSDMSAFFYVNLAGQITVVKCDTNHVLSNDCGNCISKTLSGQKIYTPVQDMFCQKGWSESIPSTRYSKDLCSIGLHTVKECKIGTTNFERVGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKKRVGSAISRTNDTIGWRDNSRRGQDIERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSGGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2337 - protein, 1337 aa, synthetic construct
  REGION 1..1337: note = derived and/or modified protein sequence (wt) from TOSV(SI-39538)__EU003175.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPGRHNCSDLDRKPFWTEFINVAKPANEMAPMSVIPPPIVKPIPVAESTTKKTIPFDKLLSEAEKELNQTKIRLETERRSNAEEAAKERARMREIEDKLRKDWELERERKDAVAEDLAKEIARRREIERKAHELDKMLKKKEREDLVARERVDEDMRNHVRRPNTTIAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSDMSAFFYVNLAGQITVVKCDTNHVLSNDCGNCISKTLSGQKIYTPVQDMFCQKGWSESIPSTRYSKDLCSIGLHTVKECKIGTTNFERVGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKKRVGSAISRTNDTIGWRDNSRRGQDIERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRHEVTTHSRKFPMVLMAMSTQPTDWGSIGLILDSGGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2338 - protein, 1337 aa, synthetic construct
  REGION 1..1337: note = derived and/or modified protein sequence (wt) from TOSV(SI-40463)__EU003176.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRVEVLNDVIPDELNPGRHNCSDLDRKPFWTEFINVAKPVNEMAPMSVIPPPIVKPIPVAESTTKKTIPFDKLLSEAEKELNQTKIRLETERRSNAEEAAKERARMREIEDKLRKDWELERERKDAVAEDLAKEIARRREIERKAHELDKMLKKKEREDLVARERVDEDMRNHVRRPNTTIAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSDMSAFFYVNLAGQITVVKCDTNHVLSNDCGNCISKTLSGQKIYTPVQDMFCQKGWSESIPSTRYSKDLCSIGLHTVKECKIGTTNFERVGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKKRVGSAISRTNDTIGWRDNSRRGQDIERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSGGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2339 - protein, 1339 aa, synthetic construct
  REGION 1..1339: note = derived and/or modified protein sequence (wt) from TOSV(SI-40614)__EU003177.1__GP
MFIAKLLLISCLVQQAYLKYTIISEIGNGTRTSFCYSSRTSLGSLLEAWDNITESIGLTSGTCKVGSLENRDCKRDIMSNYVAEVHSNLHGLGAMMHNYGDDKRVEVLNDVIPDELNPGRHNCSDLDRKPFWTEFINVAKPANKIAPISVIPPPIVKPIPIAESTIKKTIPFDKLLSEAEKELNQTKIRLETERRSNAGEAARERARMREIEDKLRKNWELERERKDAVADDLAKEIARRREIERKAHELDKMLKKKEREDQVAIERVSEDMRNHVRRPNTTIAPAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGNNMSAFFYVNLAGQITVVKCDTNHVLSNDCGNCISKTLSGQKIYTPVQDMFCQRGWTESIPSTRYSKDLCSIGLHTVKECKTGATNFERVGFIVVKSRKMYIEQMKMRSRQEFSEDQFLCYKSESSSGSSVKLKKVKVESCKGVTTSSASKCSGDEYFCSRYPCETANVEAHCILRRHSAVIEVNVNGVWVVPRCIGYEEVLVRRTSLKMEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKKLFYWLITPLCWLSVFCGWMIKSWKKRVGSAISRTNDTIGWRDNRRYGRDVERAQYTGGVPGAIYSFYGVMILGLLGNVHSCSESVIADSKVMQCTTSGSSTLCKASGTVIMKLGPIGSESCLILKGLKDNEKQFISIKTISSELTCREGESFWTTLYTPVCLSSRRCHLMGECVSDRCLKWKTNETSPEFTGKAHGEVMHENRCFEQSGGIGYGCFNVNPSCLYVHSILKSVYKNGFKIFRCVAWNHRIRLEVTTHSRKFPMVLMAMSTQPTDWGSIGLILDSEGITGTNAYSFMKHGSGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQSDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2340 - protein, 1337 aa, synthetic construct
  REGION 1..1337: note = derived and/or modified protein sequence (wt) from TOSV(SI-51903)__EU003178.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPGRHNCSDLDRKPFWTEFINVAKPANEIAPMSVIPPPIVKPIPVAESTTKKTIPFDKLLSEAEKELNQTKIRLETERRSNAEEAAKERARMREIEDKLRKDWELEREKKDAVAEDLAKEIARRREIERKAHELDKMLKKKEREDLVARERVDEDMRNHVRRPNATIAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSDMSAFFYVNLAGQITVVKCDTNHVLSNDCGNCISKTLSGQKIYTPVQDMFCQKGWSESIPSTRYSKDLCSIGLHTVKECKIGTTNFERVGFIVVKGRKMYIEQMKMRSRQEFSEDEFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKKRVGSAISRTNDTIGWRDNSRRGQDVERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSGGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGPRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2341 - protein, 1337 aa, synthetic construct
  REGION 1..1337: note = derived and/or modified protein sequence (wt) from TOSV(SI-68809)__EU003179.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPGRHNCSDLDRKPFWTEFIDVAKPANEIAPMSVIPPPIVKPIPVAESTIKKTIPFDKLLSEAEEELNQTKIRLETERRSNAEEAAKERARMREIEDKLRKDWELERERKDAVAEDLAKEIARRREIERKAHELDKMLKKKEREDLVARERVNEDMRNHVRRPNTTIAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSNMSAFFYVNLAGQITVVKCDTNHVLSNDCGNCISKTLSGQKIYTPVQDMFCQKGWSESIPSTRYSKDLCSIGLHTVKECKTGTTNFERVGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWMIRSWKRRVGSAISRTNDTIGWRDNSRRGQDVERAQYTGGAPGAKYSFYGVMILGLLGEVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLKWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSGGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2342 - protein, 1337 aa, synthetic construct
  REGION 1..1337: note = derived and/or modified protein sequence (wt) from TOSV(SI-76082)__EU003180.1__GP
MFIAKLLLISCLVQQAYLKYTIISEIGNGTRTSFCYSSRTSLGSLLEAWDNITESIGLTSGTCKVGSLENRECKRDIMSNYVAEVHSNLHGLGAMMHNYGDDKRIEVLNDVIPDELNPGRHNCSDLDRKPFWTEFINVAKPANEMAPMSVIPPPIVKPIPVAESTTKKTIPFDELLSEAEKELNQTKIRLETERRSNAEEAAKERARMREIEDKLRKDWELERERKDAVAEDLAKEIARRREIERKAHELDKMLKKKEREDLVARERVDEDMRNHVRRPNTTIAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSDMSAFFYVNLAGQITVVKCDTNHVLSNDCGNCISKTLSGQKIYTPVQDMFCQKGWSESIPSTRYSKDLCSIGLHTVKECKIGTTNFERVGFIVVKGRKMYIEQMKMRSRQEFSEDQFLCYKSEGSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLMTPLCWLSVFCGWMIRSWKKRVGSAISRTNDTIGWRDNSRRGQDVERAQYTGGAPGAKYSFYGVMILGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLRWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSGGITGTNAYSFMKHGLGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQFDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVEQALKKKNK

SEQ ID NO: 2343 - protein, 1339 aa, synthetic construct
  REGION 1..1339: note = derived and/or modified protein sequence (wt) from TOSV(TOSV/Mantova.ITA/2013)__KM507329.1__GP
MFIAKLLLISCLVQQAYLKYTIISEIGNGTRTSFCYSSRTSLGSLLEAWDNITESIGLTSGTCKVGSLENRDCKRDIMSNYVAEVHSNLHGLGAMMHNYGDDKRVEVLNDVIPDELNPGRHNCSDLDRKPFWTEFINVAKPANKIAPISVIPPPIVKPIPIAESTIKETIPFEKLLSEAEKELNQTKIRLETERRSNAEEAARERARVREIEDKLRKNWELERERKDAVADDLAKEIARRREIERKAHELDKMLKKKEREDQVAIERVSEDMRNHVRRPNTTIAPAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGNNMSAFFYVNLAGQITVVKCDTNHVLSNDCGNCFSKTLSGQKIYTPVQDMFCQRGWTESIPSTRYSKDLCSIGLHTVKECKTGTTNFERVGFIVVKSRKMYIEQMKMRSRQEFSEDQFLCYKSESSSGSSVKLKKVKVESCKGVTTSSASKCSGDEYFCSRYPCETANVEAHCILRRHSAVIEVNVNGVWVVPRCIGYEEVLVRRTSLKMEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKKLFYWLITPLCWLSVFCGWMIKSWKKRVGSAISRTNDTIGWRDNRRYGRDVERAQYTGGAPGAKYSFYGVMILGLLGNVHSCSESVIADSKVMQCTTSGSSTLCKASGTVIMKLGPIGSESCLILKGLKDNEKQFISIKTISSELTCREGESFWTTLYTPVCLSSRRCHLMGECVSDRCLKWKTNETSAEFTGKAHGEVMHENRCFEQSGGIGYGCFNVNPSCLYVHSYLKSVYKNGFKIFRCVAWNHRIRLEVTTHSRKFPMVLMAMSTQPTDWGSIGLILDSEGITGTNAYSFMKHGSGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQSDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVIIIIIARTGVQQALKKKNK

SEQ ID NO: 2344 - protein, 1339 aa, synthetic construct
  REGION 1..1339: note = derived and/or modified protein sequence (wt) from TOSV(TOSV/Phl.233/FR/2009)__HQ184337.1__GP
MFIAKLLLISCLVQQAYLKYTIISETGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLSEIVPMSVIPPPVVKPQPPAEPSSKKHVPFDVLLSEAEKELNQTKIRLEDERKSNAEETAKERARMKEIEDELRREWELERKRKDAMADDLAKETARRREIERKAHELDKMLKKKERESLIAKEKADEDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVIKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVQSCKGVTTSSASKCSGDEYFCSRYPCETANVEAHCILRRHSAIVEVNVNGVWVVPRCIGYEEVLVKRTSLKVEDTTGRECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVSPGVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2345 - protein, 1339 aa, synthetic construct
  REGION 1..1339: note = derived and/or modified protein sequence (wt) from TOSV(TOSV/Phl.51/FR/2009)__HQ184336.1__GP
MFIAKLLLISCLVQQAYLKYTIISEIGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLSEIVPMSVIPPPVVKLQPPAEPSSKKHVPFDVLLSEAEKELNQTKIRLEDERKSNAEETAKERARMKEIEDELRREWELERKRKDAMADDLAKETARRREIDRKAHELDRMLKKKERESLIAKEKADENMRSHVHEPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVVKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCSRFPCETANVEAHCILRRHSAIVEVNVNGVWVVPRCIGYEEVLVKRTSLKVEDTTERECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWVVKSWKRRVGSAISRTNDTIGWRENRRHAQDIERAQYTGGAPGAKYSFFGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLVEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVSPRVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2346 - protein, 1339 aa, synthetic construct
  REGION 1..1339: note = derived and/or modified protein sequence (wt) from TOSV(11368)__KU925897.1__GP
MFIAKLLLISCLVQQAYLKYTIISETGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLSEMVPMSVIPPPVVKLQPPAEPSSKKHVPFDVLLSEAEKELNQTKIRLEDERKSNTEETAKERARMKEIEDELRREWELERKRKDAMADDLAKETARRREIERKAHELDKMLKKKERESLIAKEKADEDMRSHVHKPNTTRALAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVIKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVQSCKGVTTSSASKCSGDEYFCSRYPCETANVEAHCILRRHSAIVEVNVNGVWVVPRCIGYEEVLVKRTSLKVEDTTGRECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLILDDYDVVYQNSQSDCSATFKNLTGCYSCDEGSRLCYQVKAEGETIFHFINEEESINVINKVSPGVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2347 - protein, 1339 aa, synthetic construct
  REGION 1..1339: note = derived and/or modified protein sequence (wt) from TOSV(5904242804)__KU935737.1__GP
MFIAKLLLISCLVQQAYLKYTIISEIGNGTRTSFCYSSRTSLGSLLEAWDNITESIGLTSGTCKVGSLENRDCKRDIMSNYVAEVHSNLHGLGAMMHNYGDDKRVEVLNDVIPDELNPGRHNCSDLDRKPFWTEFIDVAKPTNKIAPMSVIPPPIVKPIPVAESTIKKSIPFDKLLSEAEKELNQTKIRLETERRSNAEEAAKERARMREIEDKLRKDWELERERKDAVADDLAKEIARRREIERKAHELDKMLKKKEREDLVARERVSEDMRNHVRKPNTTIAPAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSNMSAFFYVNLAGQITVVKCDTNHVLSNDCGNCISKTLSGQKIYTPVQDMFCQKGWTESIPNTRYSKDLCSIGLHTVKECKTGTTNFERVGFIVVEGRKMYIEQMKMRSRQEFSEDQFLCYKSESSSGSSVKLKKVKVESCKGVTTSSASKCSGDEYFCSRYPCETANVEAHCILRRHSAVIEVNVNGVWIVPRCIGYEEVLVRRTSLKVEDTSSRECDTCLWECGKNKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCGWVIKSWKKRVGSAISRTNDTIGWRDNRRYRQDVERAQYTGGAPGAKYSFYGVMVLGLLGNVHSCSESIIADSKIMQCTTSGSSTLCKASGTVIMKLGPIGSESCLILKGLKDSEKQFISIKTISSELTCREGESFWTTLYTPVCLSSRRCHLMGECVSDRCLKWKTNETSAEFTGKAHGEVVHENRCFEQSGGIGYGCFNVNPSCLYVHSYLKSVYKNGFKIFRCVAWNHRIRLEVTTHSRKFPMVLMAMSTQPTDWGSIGLILDSEGITGTNAYSFMKHGSGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQSDCSATFKNLTGCYSCDEGSRMCYQVKAEGETIFHFINEDESINVINKVNPDVSDYCTVLHFSRPVISIEGRYDCGLSKRPMVIKGTLIATAPHDDRKHEGGSSLIVNPKGGTVDFFGWVSGLTSWLGGPLKTFLTILGFLALGLLLVVIIIIIARTGVQQALKKKNK

SEQ ID NO: 2348 - protein, 1339 aa, synthetic construct
  REGION 1..1339: note = derived and/or modified protein sequence (wt) from TOSV(5963930705)__KU935734.1__GP
MFIAKLLLISCLVQQAYLKYTIISEIGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLGEIVPMSVIPPPVVKLQPPAEPSSKKHVPFDVLLSEAEKELNQTKIRLEDERKSNAEETAKERARMKEIEEELRREWELERKRKDAMADDLAKETARRREIERKAHELDRMLKKKERESLIAKEKADEDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVVKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCSRYPCEAANVEAHCILRRHSAIVEVNVNGVWVVPRCIGYEEVLVKRTSLKVEDTTERECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWMVKSWKRRVGSAISRTNDTIGWRENRRHAQDIERAQHTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVSPGVSDYCTVLHFSSPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2349 - protein, 1339 aa, synthetic construct
  REGION 1..1339: note = derived and/or modified protein sequence (wt) from TOSV(H4906)__KU922125.1__GP
MFIAKLLLISCLVQQAYLKYTIISEIGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLSEIVPMSVIPPPVVKPQPPAEPSSKKHVPFDVLLSEAEKELNQTKIRLEDERKSNAEETAKERARMKEIEDELRREWELERKRKDAMADDLAKETARRREIERKAHELDRMLKKKERESLIAKEKADEDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVVKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCSRFPCETANVEAHCILRRHSAIVEVNVNGVWVVPRCIGYEEVLVKRTSLKVEDTTERECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEMTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVNPGVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2350 - protein, 1339 aa, synthetic construct
  REGION 1..1339: note = derived and/or modified protein sequence (wt) from TOSV(MRS2010-4319501)__KC776215.1__GP
MFIAKLLLISCLVQQAYLKYTIISEIGNGTRTSFCYSSRTSLGSLLEAWDNVTESIGLISGTCKVGSLENRDCRKDIMSNYVAEVHSNLHGLGAMMHNYADDKRVEILNDVIPDELNPGHHNCSDLDRKPFWTEFINVAKPLSEIVPMSVIPPPVVKLQPPAEPSSKKHVPFDVLLSEAEKELNQTKIRLEDERKSNAEETAKERARMKEIEDELRREWELERKRKDAMADDLAKETARRREIERKAHELDRMLKKKERESLIAKEKADEDMRSHVYKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVVKCETNHVLSSDCGNCISKSLSGQKVYTPVQDVFCQKGWTQSIPSTKYSKDICSIGLHTVKECKIGITSFERVGFIVVKGRKMYIEQMKMRSRQEYSEDQFLCYKSESSSGSSVKLKKFKVESCKGVTTSSASKCSGDEYFCSRYPCETANVEAHCILRRHSAIVEVNVNGVWVVPRCIGYEEVLVKRTSLKVEDTTGRECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRVGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGVTGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVSPGVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2351 - protein, 1339 aa, synthetic construct
  REGION 1..1339: note = derived and/or modified protein sequence (wt) from TOSV(Nice/113)__KU204982.1__GP
MFIAKLLLISCLVQQAYLKYTIISEIGNGTRTSFCYSSRTSLGSLLEAWDNVTESIGLTSGTCKVGSLENRDCGKDIMSNYVAEVHSNLHGLGAMMHNYGDDKRVEILNDVIPDELNPGHHNCSDLDRKPFWTEFINVARPLSEIAPMSVIPPPVVKLQPPAEPSSKKHVPFDVLLSEAEKELNQTKIRLEDERKSNAEETAKERARMKEIEDELRREWELERKRKDAMADDLAKETARRREIERKAHELDRMLKKKERESLIAKEKADEDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVVKCETNHVLSSDCGNCISKSLSGQKVYTPVQDVFCQKGWTQSIPSTRYSKDICSIGLHTVKECKIGTTSFERVGFIVVGGRKMYIEQMKMRSRQEYSEDQFLCYKSESGSGSSVKLKKFKVESCKGVTTSSASKCSGDEYFCSRYPCETANVEAHCILRRHSAIVEVNVNGVWVVPRCIGYEEVLVKRTSLKVEDTTERECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFYWLITPLCWLSVFCCWVIKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVSPEVSNYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2352 - protein, 1339 aa, synthetic construct
  REGION 1..1339: note = derived and/or modified protein sequence (wt) from TOSV(P233)__KU204976.1__GP
MFIAKLLLISCLVQQAYLKYTIISEIGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLSEIVPMSVIPPPVVKPQPPAEPSSKKHVPFDVLLSEAEKELNQTKIRLEDERKSNAEETAKERARMKEIEDELRREWELERKRKDAMADDLAKETARRREIERKAHELDKMLKKKERESLIAKEKADEDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVIKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVKSCKGVTTSSASKCSGDEYFCSRYPCETANVEAHCILRRHSAIVEVNVNGVWVVPRCIGYEEVLVKRTSLKVEDTTGRECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFHWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVSPGVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2353 - protein, 1339 aa, synthetic construct
  REGION 1..1339: note = derived and/or modified protein sequence (wt) from TOSV(T152)__JX867535.1__GP
MFIAKLLLISCLVQQAYLKYTIISEIGNGTRTSSCYSSRTSLGSLLEAWDNITESIGLTSGTCKVGSLENRDCKRDIMSNYVAEVHSNLHGLGAMMHNYGDDKRVEVLNDVIPDELNPGRHNCSDLDRKPFWTEFINVAKPTNKIAPISVIPPPIVKPIPIAEPTTKKNIPFDKLLSEAEKELNQTKIRLETERRSNAEEAAKERARMREIEDKLRKDWELERERKDAVADDLAKEIARRREIERKAHELDKMLKKKEREDLVAIEKVSEDMRNHVRRPNTTIAPAPTIITTLLLASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSNMSAFFYVNLAGQITVVKCDTNHVLSNDCGNCISKTLSGQKIYTPVQDMFCQKGWTESIPSTRYSKDLCSIGLHTVKECKTGTTNFERVGFIVVESRKMYIEQMKMRSRQEFSEDQFLCYKSESSSGSSVKLKKVKVESCKGVTTSSASKCSGDEYFCSRYPCETANVEAHCILRRHSAVIEVNVNGVWVVPRCIGYEEVLVRRTSLKVEDTSSRECDTCLWECGKNKLIVKTHGPKIVYATACSHGSCKSVMQKPATFVFLPYPGNSEIVGGDIGVHMTEESSPSNIHMVAHCPAKDSCEVSSCLFCVHGLLNYQCHTLFSALLISTTVMSILTLLLLLVKGAKDLVKRLFYWLITPLCWLSVFCSWMIKSWRKRVGSAISRTNDTIGWRDNRRYGQDVERAQYTGGAPGTKYSFYGVMILGLLGNVHSCSESVIADSKVMQCTTSGSSTLCKASGTVIMKLGPIGSESCLILKGLKDSEKQFISIKTISSELTCREGESFWTTLYTPVCLSSRRCHLMGECVSDRCLKWKTNETSAEFTGKAHGEVMHENKCFEQSGGIGYGCFNVNPSCLYVHSYLKSVYKNGFKIFRCVAWNHRIRLEVTTHSRKFPMVLMAMSTQPTDWGSIGLILDSEGITGTNAYSFMKHGSGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQSDCSATFKNLTGCYSCDEGSRMCYQVKAEGETIFHFVNEDESINVINKVSPDVSDYCTVLHFSRPVISIEGRYDCGLSKRPMVIKGTLIATAPHDDRKHEGGSSLVVNPKGGTVDFFGWVSGLTSWLGGPLKTFLTILGFLALGLLLVVVIIIIARTGVQQALKKKNK

SEQ ID NO: 2354 - protein, 1339 aa, synthetic construct
  REGION 1..1339: note = derived and/or modified protein sequence (wt) from TOSV(TOSV/P51)__KU204979.1__GP
MFIAKLLLISCLVQQAYLKYTIISEIGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLSEIVPMSVIPPPVVKLQPPAEPSSKKHVPFDVLLSEAEKELNQTKIRLEDERKSNAEETAKERARMKEIEDELRREWELERKRKDAMADDLAKETARRREIDRKAHELDRMLKKKERESLIAKEKADENMRSHVHEPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVVKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCSRYPCETANVEAHCILRRHSAIVEVNVNGVWVVPRCIGYEEVLVKRTSLKVEDTTGRECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFYWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLVEYQPEMDTAECTTNMIDPMAIFNRGSLPQVRDGMTFTQSIEKNTVQALTTGEVKASIRLTLDDYDVVYQNSQSDCSATFKNLTGCYSCDEGSRLCYQVKAEGETIFHFINEEESINVINKVSPRVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2355 - protein, 1339 aa, synthetic construct
  REGION 1..1339: note = derived and/or modified protein sequence (wt) from TOSV(TOSV_Italy/BB8/2014/human)__KY626661.1__GP
MFIAKLLLISCLVQQAYLKYTIISEIGNGTRTSFCYSSRTSLGSLLEAWDNITESIGLTSGTCKVGSLENRDCKRDIMSNYVAEVHSNLHGLGAMMHNYGDDKRVEVLNDVIPDELNPGRHNCSDLDRKPFWTEFIDVAKPTNKIAPMSVIPPPIVKPIPVAESTIKKSIPFDKLLSEAEKELNQTKIRLETERRSNAEEAAKERARMREIEDKLRKDWELERERKDAVADDLAKEIARRREIERKAHELDKMLKKKEREDLVARERVSEDMRNHVCKPNTTIAPAPTIITTLLMASAVMAGPLENRETNHLLNRPGNGAYTLSDFAESTCTLAYGSECKSWEHQLDELSFPFFHSNLDKYSMLEAATETIPILNKSSAVCTISPSTHSSNACGREASLIKKKCGSNMSAFFYVNLAGQITVVKCDTNHVLSNDCGNCISKTLSGQKIYTPVQDMFCQKGWTESIPNTRYSKDLCSIGLHSVKECKTGTTNFERVGFIVVKGRKMYIEQMKMRSRQEFSEDQFLCYKSESSSGSSVKLKKVKVESCKGVTTSSASKCSGDEYFCSRYPCETANVEAHCILRRHSAVIEVNVNGVWIVPRCIGYEEVLVRRTSLKVEDTSSRECDTCLWECGKDKLIVKTHGPKIVYATACSHGSCKSVMQKPATFVYLPYPGNSEIVGGDIGVHMTEESSPSNIHMVAHCPAKDSCEVSSCLFCVHGLLNYQCHTLFSALLISTTVMSILTLLLLLMKGAKDLVKRLFYWLITPLCWLSVFCGWVIKSWKKRVGSAISRTNDTIGWRDNRRYRQDVERAQYTGGAPGAKYSFYGVMVLGLLGNVHSCSESVIADSKIMQCTTSGSSTLCKASGTVIMKLGPIGSESCLILKGLKDSEKQFISIKTISSELTCREGESFWTTLYTPVCLSSRRCHLMGECVSDRCLKWKTNETSAEFTGKAHGEVMHENRCFEQSGGIGYGCFNVNPSCLYVHSYLKSVYKNGFKTFRCVAWNHRIRLEVTTHSRKFPMVLMAMSTQPTDWGSIGLILDSEGITGTNAYSFMRHGSGSFAIIDDPYSPEPRKGFLGEVRCPTEETAIRASPSCKMAPNLIEYQPEMDTAECTTNMIDPMAIFNRGSLPQVRDGMTFTQSIEKNTVQALTTGEVRASIRLTLDDYDVVYQNSQSDCSATFKNLTGCYSCDEGSRMCYQVKAEGETIFHFINEDESINVISKVNPDVSDYCTVLHFSRPVISIEGRYDCGLSKRPMVIKGTLIATAPHDDRKHEGGSSLIVNPKGGTVDFFGWVSGLTSWLGGPLKTFLTILGFLALGLLLVVIIIIIARTGVQQALKKKNK

SEQ ID NO: 2356 - protein, 1339 aa, synthetic construct
  REGION 1..1339: note = derived and/or modified protein sequence (wt) from TOSV(TOSV-54441132704)__KX010933.1__GP
MFIAKLLLISCLVQQAYLKYTIISEIGNGTRTSFCYSSRTSLGSLLEAWDNVTESIGLTSGTCKVGSLENRDCRKDIMSNYVAEVHSNLHGLGAMMHNYGDDKRVEILNDVIPDELNPGHHNCSDLDRKPFWTEFINVAKPLSEIVPMSVIPPPVVKLQPPAEPSSKKHVPFDVLLSEAEKELNQTKIRLEDERKSNAEETAKERARMKEIEDELRREWELERKRKDAMADDLAKETARRREIERKAHELDKMLKKKERKSLIAKEKADVDMRSHVHKPNTTRAPAPTIITTLLMASAALAGPLENRETNHLLNRPGNGAYTLSDFAESTCTLAYGSECKSWEHLLNEELFPFFHSNLDKYSMLEAATETVPILNKSSAVCTISPSTHSSNACGREASVIRKKCYSNMSAFFYINLAGQITVIKCETNHVLSSDCGNCISKSLSGQKVYTPVQDVFCQKGWTQSIPSTRYSKDICSIGLHTVKECKIGTTSFERVGFIVVKGRKMYIEQMKMRSRQEYSEDQFLCYKSESGSGSSVKLKKFKVESCKGVTTSSASKCSGDEYFCSRYPCETANVEAHCILRRHSAIVEVNVNGVWVVPRCIGYEEVLVKRTSLKVEDTTGRECDSCLWECGKNKLIVKTHGPKVVYATACSHGSCKSVMQKPATFVYLPYPGNSEIVGGDIGIHMTEESSPSNIHLVAHCPARDSCDVSDCLFCVHGLLNYQCHTLFSALLISTTVMSILTLLLLLVKGAKDLVKKLFYWLITPLCWLSVFCCWVVKSWKRRVGSAISRTNDTIGWRENRRHAQDIERAQYTGGAPGAKYSFYGVMILGLLSSAQSCSESVIADSKIMQCTTSGSSTLCKASGTVIMRLGPIGSESCLILKGLKDSEKQFISIKTISSELTCREGESFWTTLYTPICLSSRRCHLMGECVSDRCLKWKTNQTSAEFTGKAHGDVMHENRCFEQSGGIGYGCFNVNPSCLYVHSYLKSVYRNGFKVFRCVAWNHRIRLEVTTHSRKFPMVLMAMSTQPTDWGSIGLILDSEGITGTNSYSFMKHGSGSFAIIDDPYSPEPRKGFLGEVRCPTEETAMRASPSCKMAPNLIEYQPEMDTAECTTNMIDPMAIFNRGSLPQVRDGMTFTQSIEKNTVQALTTGEVKASIRLILDDYDVVYQNSQSDCSATFKNLTGCYSCDEGSRLCYQVKAEGETIFHFINEEESINVINKVSPGVSDYCTVLHFSRPVISIEGTYDCGLSKRPMVIKGTLIATAPHDDRKHEGGSSLVVNPKGGSVDFFGWLSGLTSWLGGPLKTFLTILGFLAVGLLLVVIIIIIIRTGMQQALKKKIK

SEQ ID NO: 2357 - protein, 1073 aa, synthetic construct
  REGION 1..1073: note = derived and/or modified protein sequence (wt) from SFTSV(HB29)__NC_018138.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGTRVRPKCYGFSRMMATLEVNPPEQRIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVRLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2358 - protein, 1073 aa, synthetic construct
  REGION 1..1073: note = derived and/or modified protein sequence (wt) from SFTSV(Jilin)__KT890281.1__GP
MMKVIWFSSLICLVIQCGGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMAPLEVNPPEQRIGQCTGCHLECINGGVRLITLTSELKSATVCAYHFCSCATSGKKSTEIQFHSGSLVGKTAIHVKGALVDGTEFTFEGRCMFPDGCDAVDCTFCREFLKNPQCYPAQKWLFIIIVILLGYAGLMLLTNVLKAMGVWGSWVIAPVKLVFAIIKKLMRAVSCLMGKLMDRGRQVIHEEIGENREGNQDDVRIEMARPRRVRHWMYSPVIQTIVAIGLAEGCDEMVHADSKLVSCRQGSGNMKECVTTGRALLPAVNPGQEACLHFTAPGSPDSKCLKIRVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2359 - protein, 1073 aa, synthetic construct
  REGION 1..1073: note = derived and/or modified protein sequence (wt) from SFTSV(05-Lu'an(CHN)-2015)__KX302597.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASGAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSYLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2360 - protein, 1073 aa, synthetic construct
  REGION 1..1073: note = derived and/or modified protein sequence (wt) from SFTSV(07-Lu'an(CHN)-2015)__KX302598.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2361 - protein, 1073 aa, synthetic construct
  REGION 1..1073: note = derived and/or modified protein sequence (wt) from SFTSV(12-Lu'an(CHN)-2014)__KX302595.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKVDGIVFNQCDSESLPQPIDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVMAPVKLMFAIMKKLMRSVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSYFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCRGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGVLALFFLIMSLFKLGTKQVIRSRTKLA

SEQ ID NO: 2362 - protein, 1073 aa, synthetic construct
  REGION 1..1073: note = derived and/or modified protein sequence (wt) from SFTSV(14-Lu'an(CHN)-2014)__KX302596.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKVDGIVFNQCDSESLPQPIDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVMAPVKLMFAIMKKLMRSVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCRGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGVLALFFLIMSLFKLGTKQVFRSRTKLA

SEQ ID NO: 2363 - protein, 1073 aa, synthetic construct
  REGION 1..1073: note = derived and/or modified protein sequence (wt) from SFTSV(18-Lu'an(CHN)-2015)__KX302599.1__GP
MMKVIWFFSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYRGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAEGCDEMVHADSKLVSCRQGSGNVKECVTTGRALLPAVNPGQEACLHFTAPGSPDSKCLKIRVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSITYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2364 - protein, 1073 aa, synthetic construct
  REGION 1..1073: note = derived and/or modified protein sequence (wt) from SFTSV(27-Lu'an(CHN)-2015)__KX302600.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2365 - protein, 1073 aa, synthetic construct
  REGION 1..1073: note = derived and/or modified protein sequence (wt) from SFTSV(36-Lu'an(CHN)-2015)__KX302601.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVVLTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2366 - protein, 1073 aa, synthetic construct
  REGION 1..1073: note = derived and/or modified protein sequence (wt) from SFTSV(42-Lu'an(CHN)-2015)__KX302602.1__GP
MMKVIWFSSLICFVIQCSGDSGPIICAGPIHSNKSADIPHLLGFSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGRMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVSNYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2367 - protein, 1073 aa, synthetic construct
  REGION 1..1073: note = derived and/or modified protein sequence (wt) from SFTSV(44-Lu'an(CHN)-2015)__KX302603.1__GP
MMKVIWFSSLICFVIQCSGDSGPIICAGPIHSNKSADIPHLLGFSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVSNYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2368 - protein, 1073 aa, synthetic construct
  REGION 1..1073: note = derived and/or modified protein sequence (wt) from SFTSV(52-Lu'an(CHN)-2015)__KX302604.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKRSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2369 - protein, 1073 aa, synthetic construct
  REGION 1..1073: note = derived and/or modified protein sequence (wt) from SFTSV(HL/Injected)__KF791953.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2370 - protein, 1073 aa, synthetic construct
  REGION 1..1073: note = derived and/or modified protein sequence (wt) from SFTSV(HL/Larvae/G2)__KF791955.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSRTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2371 - protein, 1073 aa, synthetic construct
  REGION 1..1073: note = derived and/or modified protein sequence (wt) from SFTSV(JS2011-004)__KC505124.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCGGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIMKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2372 - protein, 1073 aa, synthetic construct
  REGION 1..1073: note = derived and/or modified protein sequence (wt) from SFTSV(JS2011-013-1)__KC505127.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVKYRGLRLSLSEITATCTGEVTNVSGCYSCMTGAKVSIKLHSSKNSTAHVRCKGDETAFSVLEGGHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2373 - protein, 1073 aa, synthetic construct
  REGION 1..1073: note = derived and/or modified protein sequence (wt) from SFTSV(JS2011-027)__KC505130.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNEPEQRIGQCTGCHLECISGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAMGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSINYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2374 - protein, 1073 aa, synthetic construct
  REGION 1..1073: note = derived and/or modified protein sequence (wt) from SFTSV(JS2011-034)__KC505133.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTFLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSCCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLLKLGTKQVYRSRTKLA

SEQ ID NO: 2375 - protein, 1073 aa, synthetic construct
  REGION 1..1073: note = derived and/or modified protein sequence (wt) from SFTSV(JS2011-062)__KC505136.1__GP
MMKVIWFSSLICLVIQCSGDSGPIICAGPIHSNKSADIPHLLGYSEKICQIDRLIHVSSWLRNHSQFQGYVGQRGGRSQVSYYPAVNSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIMKKLMRTVSCLMGKLIDRGRQVIHEEIGENGEGNRDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGLIGVLLGGLALFFLIMSLFKLGTKQVFRSRTKLA

SEQ ID NO: 2376 - protein, 1073 aa, synthetic construct
  REGION 1..1073: note = derived and/or modified protein sequence (wt) from SFTSV(JS2011-109)__KC505139.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2377 - protein, 1073 aa, synthetic construct
  REGION 1..1073: note = derived and/or modified protein sequence (wt) from SFTSV(JS2011-13-2)__KR230770.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2378 - protein, 1073 aa, synthetic construct
  REGION 1..1073: note = derived and/or modified protein sequence (wt) from SFTSV(JS2011-69)__KR230771.1__GP
MMKVIWFSSLVCLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCDSESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVMAPVKLMFAIIKKLMRSVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAVRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGVLALFFLIMSLFKLGTKQVFRSRTKLA

SEQ ID NO: 2379 - protein, 1073 aa, synthetic construct
  REGION 1..1073: note = derived and/or modified protein sequence (wt) from SFTSV(JS2012-020)__KC505142.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCGGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVGPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIIILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVSYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2380 - protein, 1073 aa, synthetic construct
  REGION 1..1073: note = derived and/or modified protein sequence (wt) from SFTSV(JS2012-035)__KC505145.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLGVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2381 - protein, 1073 aa, synthetic construct
  REGION 1..1073: note = derived and/or modified protein sequence (wt) from SFTSV(JS2012-79)__KR230772.1__GP
MMKVIWFSSLTCFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLSAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGGHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2382 - protein, 1073 aa, synthetic construct
  REGION 1..1073: note = derived and/or modified protein sequence (wt) from SFTSV(JS2013-44)__KR230773.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEETSEAKCRCSLVHKPGEVVVSYGGMRIRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDISAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFSMIMSLFKLGTKQVFRSRTKLA

SEQ ID NO: 2383 - protein, 1073 aa, synthetic construct
  REGION 1..1073: note = derived and/or modified protein sequence (wt) from SFTSV(JS2013-46)__KR230774.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNEPEQRIGQCTGCHLECISGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAMGLAEGCDEMVHADSKLVSCRQGSGNMKECVTTGRALLPAVNPGQEACLHFMAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSINYRGLRLSLSEISATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2384 - protein, 1073 aa, synthetic construct
  REGION 1..1073: note = derived and/or modified protein sequence (wt) from SFTSV(JS2013-52)__KR230775.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTFLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGVLALFFLIMSLFKLGTKQVFRSRTKLA

SEQ ID NO: 2385 - protein, 1073 aa, synthetic construct
  REGION 1..1073: note = derived and/or modified protein sequence (wt) from SFTSV(JS2013-69)__KR230776.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDIIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRLGQCTGCHLECINGGVRLITLTSELKSATVCASHFCSSATSGKKSTEIQFHSGSLVGKTAIHVKGALVDGTEFTLESSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGVLALFFLIMSLFKLGTKQVFRSRTKLA

SEQ ID NO: 2386 - protein, 1073 aa, synthetic construct
  REGION 1..1073: note = derived and/or modified protein sequence (wt) from SFTSV(JS2013-71)__KR230777.1__GP
MMKVIWFSSLICFVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2387 - protein, 1073 aa, synthetic construct
  REGION 1..1073: note = derived and/or modified protein sequence (wt) from SFTSV(JS2014-03)__KR230778.1__GP
MMKVIWFSSLIYFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTFLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGRVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2388 - protein, 1073 aa, synthetic construct
  REGION 1..1073: note = derived and/or modified protein sequence (wt) from SFTSV(JS2014-16)__KR230780.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKVDGIVFNQCDSESLPQPIDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVMAPVKLMFAIIKKLMRSVSCMMGKLMDRGRQVIHEEIGENREGNQDDVRIEMARPRRVRHWMYSPVILTILAIGLAEGCDEMVHADSKLVLCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCRGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGVLALFFLIMSLFKLGTKQVFRSRTKLA

SEQ ID NO: 2389 - protein, 1073 aa, synthetic construct
  REGION 1..1073: note = derived and/or modified protein sequence (wt) from SFTSV(JS2014-18)__KR230781.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPTTPIPEETFLELKSFSQSEFPDVCKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2390 - protein, 1073 aa, synthetic construct
  REGION 1..1073: note = derived and/or modified protein sequence (wt) from SFTSV(JS2014-31)__KR230782.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGVLALFFLIMSLFKLGTKQVFRSRTKLA

SEQ ID NO: 2391 - protein, 1073 aa, synthetic construct
  REGION 1..1073: note = derived and/or modified protein sequence (wt) from SFTSV(JS2014-33)__KR230783.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGNCMFPDGCDAVDCTFCREFLKNPQCYPAKKWLFIIIVILLGYAGLMLLTNVLKAIGIWGSWVIAPVKLIFAIIKKLMRAVGCLMGKLMDRGRQVIHEEIGENREGNQDDVRIEMARPRRVRHWMYSPVILTILAIGLAESCDEMVHADSKLVSCRQGGGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSAVPTGANIPSPTDWLNALFGNGLSRWILGVIGVLLGGLALFFMIMSLFKLGTKQAFRSRTKLA

SEQ ID NO: 2392 - protein, 1073 aa, synthetic construct
  REGION 1..1073: note = derived and/or modified protein sequence (wt) from SFTSV(JS2014-39)__KR230784.1__GP
MMKVIWFSSLTCFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEETSEAKCRCSLVHKPGEVVVSYGGMRIRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDISAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFSMIMSLFKLGTKQVFRSRTKLA

SEQ ID NO: 2393 - protein, 1073 aa, synthetic construct
  REGION 1..1073: note = derived and/or modified protein sequence (wt) from SFTSV(JS2014-H.longicornis-02)__KR230786.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPVEAFLELKSFSQSEFPDICKIDGIVFNQCEGESLPQPFDVAWMDVGHSHKIIMREHKTKWVQESSSKDFVCYKEGTGPCPESEEKTCKTSGSCRGDMQFCKVAGCEHGEEASEAKCRCSLVHKPGEVVVSYGGMRIRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2394 - protein, 1073 aa, synthetic construct
  REGION 1..1073: note = derived and/or modified protein sequence (wt) from SFTSV(JS2014-H.longicornis-03)__KR230787.1__GP
MMKVIWFSSLTCFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTFLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2395 - protein, 1073 aa, synthetic construct
  REGION 1..1073: note = derived and/or modified protein sequence (wt) from SFTSV(JS2014-Hedgehog-02)__KR230789.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2396 - protein, 1073 aa, synthetic construct
  REGION 1..1073: note = derived and/or modified protein sequence (wt) from SFTSV(KACNH)__KU507558.1__GP
MMKVIWFSSLICLVIQCSGDSGPIICAGPIHSNKSASIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASDAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFILIVILLGYAGLMLITNVLKAIGVWGSWVIAPVKLMFAIIKKLMRTVSCLMGKLMDRGRQVIHEEIGENGEGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2397 - protein, 1073 aa, synthetic construct
  REGION 1..1073: note = derived and/or modified protein sequence (wt) from SFTSV(KACNH2)__KU507559.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEERTCKTSGSCRGDMQFCKVAGCEHGEEASEAKCRCSLVHKPGEVVVSYGGMRVRPKCYGFSRMMATLEVNPPEQRIGQCTGCHIECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCRQGGGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGIHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2398 - protein, 1073 aa, synthetic construct
  REGION 1..1073: note = derived and/or modified protein sequence (wt) from SFTSV(KACNH3)__KP663744.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASGAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEVTATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2399 - protein, 1073 aa, synthetic construct
  REGION 1..1073: note = derived and/or modified protein sequence (wt) from SFTSV(KADGH)__KU507548.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLAQPFDVAWMDVGHSHKIIMREHKTKWVQESSSKDFVCYKEGTGPCSESEEKTCKTSGSCRGDMQFCKVAGCEHGEETSVAKCRCSLVHKPGEVVVSYGGMRVRPKCYGFSRMMATLEVNPPEQRIGQCTGCHLECISGGVRLITLTSELKSATVCASHFCSSATSGKKSTEIQFHSGSLVGKAAIHVKGVLVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIRLHSSKNSTAHVRCKEDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2400 - protein, 1073 aa, synthetic construct
  REGION 1..1073: note = derived and/or modified protein sequence (wt) from SFTSV(KAGBH)__KU507560.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLIRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2401 - protein, 1073 aa, synthetic construct
  REGION 1..1073: note = derived and/or modified protein sequence (wt) from SFTSV(KAGBH3)__KU507561.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEETSEAKCRCSLVHKPGEVVVSYGGMRVRPKCYGFSRMMATLEVNPPEQRIGQCTGCHLECINGGVRIITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVLCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYAVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2402 - protein, 1073 aa, synthetic construct
  REGION 1..1073: note = derived and/or modified protein sequence (wt) from SFTSV(KAGBH4)__KU507562.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2403 - protein, 1073 aa, synthetic construct
  REGION 1..1073: note = derived and/or modified protein sequence (wt) from SFTSV(KAGBH5)__KP663738.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPLYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEETSEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGRCMFPDGCDAVDCTFCREFLKNPQCYPAKKWLFIIIVILLGYAGLMLLTNVLKAVGVWGSWVIAPVKLMFAIIKKLMRSVSCLMGKLMDRGRQVIHEEIGENREGNQDDVRIEMARPRRVRHWMYSPVILAILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2404 - protein, 1073 aa, synthetic construct
  REGION 1..1073: note = derived and/or modified protein sequence (wt) from SFTSV(KAGBH6)__KP663741.1__GP
MIKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLIRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEISATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQAFRSRTKLA

SEQ ID NO: 2405 - protein, 1073 aa, synthetic construct
  REGION 1..1073: note = derived and/or modified protein sequence (wt) from SFTSV(KAGNH)__KU507550.1__GP
MMKVIWFSSLICLVIQCSGDTGPIICAGPIHSNKSANIPHLLGYSEKICQIDRLIHVSSWLRNHSQFQGYVGRRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLIRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKISIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTNQVFRSRTKLA

SEQ ID NO: 2406 - protein, 1073 aa, synthetic construct
  REGION 1..1073: note = derived and/or modified protein sequence (wt) from SFTSV(KAGNH4)__KU507551.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAGGCDEMVHADSKLVSCRQGSGNMKECVTTGRALLPAVNPGQEACLHFTAPGSPDSKCLKIRVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSRKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFLLIMSLFKLGTKQVFRSRTKLA

SEQ ID NO: 2407 - protein, 1073 aa, synthetic construct
  REGION 1..1073: note = derived and/or modified protein sequence (wt) from SFTSV(KAGWH2)__KU507564.1__GP
MMKVIWFSSLICLVIQCGGDTGPIICAGPIHSNKSAGIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDVCKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2408 - protein, 1073 aa, synthetic construct
  REGION 1..1073: note = derived and/or modified protein sequence (wt) from SFTSV(KAGWH3)__KP663735.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLIVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGEVREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFRLGTKQVFRSRTKLA

SEQ ID NO: 2409 - protein, 1073 aa, synthetic construct
  REGION 1..1073: note = derived and/or modified protein sequence (wt) from SFTSV(KAICH)__KU507565.1__GP
MMKVIWFSSLICLVIQCGGDTSPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECISGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEMEELKSKKLALAPCNQAGMGVVGKVGEIQCSSEESARTIKKDGCIWNADLVGIELRVDDAVCYSKITSVEAVTNYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESKVTLRGNLIFLDVPKFVDGSYMQTYHSTVPTGANIPSPTDWLNALFGNGLSRWFLGVIGVLLGGLALFFLIMSLFKLGTKQVFRSRSKLA

SEQ ID NO: 2410 - protein, 1073 aa, synthetic construct
  REGION 1..1073: note = derived and/or modified protein sequence (wt) from SFTSV(KAJJH)__KU507566.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEERTCKTSGSCRGDMQFCKVAGCEHGEEASEAKCRCSLVHKPGEVVVSYGGMRVRPKCYGFSRMMATLEVNPPEQRIGQCTGCHIECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCRQGGGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2411 - protein, 1073 aa, synthetic construct
  REGION 1..1073: note = derived and/or modified protein sequence (wt) from SFTSV(KAJNH2)__KU507552.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVLKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNRDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRAKLA

SEQ ID NO: 2412 - protein, 1073 aa, synthetic construct
  REGION 1..1073: note = derived and/or modified protein sequence (wt) from SFTSV(ZL13-32)__KU361342.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2413 - protein, 1073 aa, synthetic construct
  REGION 1..1073: note = derived and/or modified protein sequence (wt) from SFTSV(AHL/China/2011)__JQ670930.1__GP
MMKVIWFSSLICLVIQCSGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNPPEQRIGQCTGCHLECINGGVRLITLTSELKSATVCASHFCSSATSGKKNTEIQFHSGSLVGKTAIHVKGALVDGTDFTFEGSCMFPDGCDAVDCTFCREFLKNPQCYPAKKWLFIIIVILLGYAGLMLLTNVLKAIGVWGSWVIAPVKLMFAIMKKLMRSVSCLMGKLMDRGRQVIHEEIGENREGNQDDVRIEMARPRRVRHWMYSPVILTILATGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSVKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2414 - protein, 1073 aa, synthetic construct
  REGION 1..1073: note = derived and/or modified protein sequence (wt) from SFTSV(AH-YTY/China/05/2012)__KR017849.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRAVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2415 - protein, 1073 aa, synthetic construct
  REGION 1..1073: note = derived and/or modified protein sequence (wt) from SFTSV(AHZ/China/2011)__JQ670931.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGILVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKIAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKWINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELSMPSGEVRTFHPMSGIPTQVFKGVSVTYLGSDMEVSGLTGLCEIEELKSKKLALAPCNQAGMGVVGKVGEIQCSSEESARTIKKDGCIWNADLVGIELRVDDAVCYSKITSVESVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGLIGVLLGGLALFFMIMSLFKLGTKQVFRSRTKLA

SEQ ID NO: 2416 - protein, 1073 aa, synthetic construct
  REGION 1..1073: note = derived and/or modified protein sequence (wt) from SFTSV(DS02/CHN/2013)__KR698332.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELKSATVCASHFCSSATSGKKSTEIQFHSGSLVGKAAIHVKGALVDGTEFTFEGSCMFPDGCDAVDCTFCREFLKNLQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2417 - protein, 1073 aa, synthetic construct
  REGION 1..1073: note = derived and/or modified protein sequence (wt) from SFTSV(DS03/CHN/2013)__KR698333.1__GP
MMKVIWFSSLIYLVIQCSGDSGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCERESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGRTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDIRIEMARPRRVRHWMYSPVILTILAVGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2418 - protein, 1073 aa, synthetic construct
  REGION 1..1073: note = derived and/or modified protein sequence (wt) from SFTSV(DS04/CHN/2013)__KR698334.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFRPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVVNYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2419 - protein, 1073 aa, synthetic construct
  REGION 1..1073: note = derived and/or modified protein sequence (wt) from SFTSV(DS05/CHN/2013)__KR698335.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCHGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2420 - protein, 1073 aa, synthetic construct
  REGION 1..1073: note = derived and/or modified protein sequence (wt) from SFTSV(HB154/China/2011)__JQ733560.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVINEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFSLIMFLLKLGTKQVFRSRTKLA

SEQ ID NO: 2421 - protein, 1073 aa, synthetic construct
  REGION 1..1073: note = derived and/or modified protein sequence (wt) from SFTSV(HB155/China/2011)__JQ733563.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPRFVDGSYMQTYHSTVPTGANIPSPTDWLNALFGNGLSRWILGVIGVLLGGLALFFLIMFLLKLGTKQVFRSRTKLA

SEQ ID NO: 2422 - protein, 1073 aa, synthetic construct
  REGION 1..1073: note = derived and/or modified protein sequence (wt) from SFTSV(HB156/China/2011)__JQ733566.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERIHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2423 - protein, 1073 aa, synthetic construct
  REGION 1..1073: note = derived and/or modified protein sequence (wt) from SFTSV(HB2014-04)__KR080475.1__GP
MMKVIWFPSLICFVIQCSGDSGPIICAGPIHSNKSADIPHLLGYSEKICQIDRLIHVSSWLRNHSQFQGYVGQRGGRSHVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRSKLA

SEQ ID NO: 2424 - protein, 1073 aa, synthetic construct
  REGION 1..1073: note = derived and/or modified protein sequence (wt) from SFTSV(HNXH)__KT254590.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFALIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVTGVLLGGLALFFLIMSLFKLGTKQIFRSRTKLA

SEQ ID NO: 2425 - protein, 1073 aa, synthetic construct
  REGION 1..1073: note = derived and/or modified protein sequence (wt) from SFTSV(JS2012-goat01)__KC473538.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSLDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2426 - protein, 1073 aa, synthetic construct
  REGION 1..1073: note = derived and/or modified protein sequence (wt) from SFTSV(JS2012-tick01)__KC473541.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2427 - protein, 1073 aa, synthetic construct
  REGION 1..1073: note = derived and/or modified protein sequence (wt) from SFTSV(LN2012-14)__KF887436.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVWIEMARPRRVRYWMYSPVILTILAVGLAESCDEMVHADSKLVSCRQGSGNMKECVTTGRALLPAVNPGQEACLHFTAPGSPDSKCLKIRVKRINLKCKKSSSYFVPDARSRCTSVRRCRWAGDCQSGCPPHFTSNSFSDDWVGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2428 - protein, 1073 aa, synthetic construct
  REGION 1..1073: note = derived and/or modified protein sequence (wt) from SFTSV(LN2012-34)__KF887437.1__GP
MMKVIWFFSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNVKECVTTGRALLPAVNPGQEACLHFTAPGSPDSKCLKIRVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSITYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2429 - protein, 1073 aa, synthetic construct
  REGION 1..1073: note = derived and/or modified protein sequence (wt) from SFTSV(LN2012-41)__KF887438.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNVKECVTTGRALLPAVNPGQEACLHFTAPGSPDSKCLKIRVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVVNYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2430 - protein, 1073 aa, synthetic construct
  REGION 1..1073: note = derived and/or modified protein sequence (wt) from SFTSV(LN2012-58)__KF887440.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPVQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILVMGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2431 - protein, 1073 aa, synthetic construct
  REGION 1..1073: note = derived and/or modified protein sequence (wt) from SFTSV(NB24/CHN/2013)__KR698337.1__GP
MMKVIWFSSLICLVIQCSGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECVNGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFINIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAVGLAEGCDEMVHADSKLVSCKQGSGNMKECVTTGRALLPAVNPGQEACLHFTAPGSPDSKCLKIKVKKINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRSKLA

SEQ ID NO: 2432 - protein, 1073 aa, synthetic construct
  REGION 1..1073: note = derived and/or modified protein sequence (wt) from SFTSV(NB31/CHN/2013)__KR698338.1__GP
MMKVIWFSSLICFVIQCSGDTGPIICAGPIHSNKSANIPHLLGYSEKICQIDRLIHVSSWLRNHSQFQGYVGQRGGRSQVSYYPSENSNSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKNTEIQFHSGSLVGKTVIHVKGALVDGTEFTFEGSCMFPDGCEAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNRDDVRIEMARPRRVRHWMYSPVILTILAIGLAEGCDEMVHADSKLVSCKQGSGNMKECVTTGRVLLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVVGVLLGGLVLFFLIMSLFKLGTKQVFRSRTKLA

SEQ ID NO: 2433 - protein, 1073 aa, synthetic construct
  REGION 1..1073: note = derived and/or modified protein sequence (wt) from SFTSV(NB38/CHN/2013)__KR698341.1__GP
MMKVIWFSSLICLVIQCGGDTSPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHEEEASEAKCRCSLVHKPGEVVVSYGGMRVRPKCYGFSRMMATLEVNQPEQRIGQCTGCHLECISGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEMEELKSKKLALAPCNQAGMGVVGKVGEIQCSSEESARTIKKDGCIWNADLVGIELRVDDAVCYSKITSVEAVANHSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESKVTLRGNLIFLDVPKFVDGSYMQTYHSTVPTGANIPSPTDWLNALFGNGLSRWFLGVIGVLLGGLALFFLIMSLFKLGTKQVFRSRSKLA

SEQ ID NO: 2434 - protein, 1073 aa, synthetic construct
  REGION 1..1073: note = derived and/or modified protein sequence (wt) from SFTSV(NB39/CHN/2014)__KR698342.1__GP
MMKVIWFSSLICLVIQCSGDTGPIICAGPIHSNKSADIPHLLGYSEKICQIDRLIHVSSWLRNHSQFQGYVGRRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECVNGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAVGLAEGCDEMVHADSKLVSCKQGSGNMKECVTTGRALLPAVNPGQEACLHFTAPGSPDLKCLKIKVKKINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2435 - protein, 1073 aa, synthetic construct
  REGION 1..1073: note = derived and/or modified protein sequence (wt) from SFTSV(QD7)__KR706566.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTMSCLMGKLMDRGRQVIHEEIGENREGNQDDVRIEMARPRRVRHWMYSPVILTFLAIGLAESCDEMVHADSKLASCRQGSGNMKECVTTGRALHPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2436 - protein, 1073 aa, synthetic construct
  REGION 1..1073: note = derived and/or modified protein sequence (wt) from SFTSV(Rodent01/NB/CHN/2014)__KR698343.1__GP
MMKVIWFSSLICLVIQCSGDTGPIICAGPIHSNKSADIPHLLGYSEKICQIDRLIHVSSWLRNHSQFQGYVGRRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECVNGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAVGLAEGCDEMVHADSKLVSCKQGSGNMKECVTTGRALLPAVNPGQEACLHFTAPGSPDLKCLKIKVKKINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMIGAKVSIKLHSNKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2437 - protein, 1073 aa, synthetic construct
  REGION 1..1073: note = derived and/or modified protein sequence (wt) from SFTSV(SDLZtick12/2010)__JQ684872.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTFLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2438 - protein, 1073 aa, synthetic construct
  REGION 1..1073: note = derived and/or modified protein sequence (wt) from SFTSV(Zhao)__KF374684.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKVSGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2439 - protein, 1073 aa, synthetic construct
  REGION 1..1073: note = derived and/or modified protein sequence (wt) from SFTSV(Zhejiang/01/2011)__KJ597824.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2440 - protein, 1073 aa, synthetic construct
  REGION 1..1073: note = derived and/or modified protein sequence (wt) from SFTSV(ZJ2013-06)__KP280204.1__GP
MMKVIWFSSLICLVIQCSGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECVNGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFINIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAVGLAEGCDEMVHADSKLVSCKQGSGNMKECVTTGRALLPAVNPGQEACLHFTAPGSPDSKCLKIKVKKINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2441 - protein, 1073 aa, synthetic construct
  REGION 1..1073: note = derived and/or modified protein sequence (wt) from SFTSV(ZJZHSH-AM/China/05/2012)__KR017846.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDIQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2442 - protein, 1073 aa, synthetic construct
  REGION 1..1073: note = derived and/or modified protein sequence (wt) from SFTSV(ZJZHSH-CXD/China/05/2012)__KR017858.1__GP
MMKVIWFSSLICLVIQCGGDTGPIICAGPIHSNKSAGIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDVCKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQNDVRIEMARPRRVRHWMYSPVILTILAIGFAEGCDEMVHADSKLVSCRQGSENMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2443 - protein, 1073 aa, synthetic construct
  REGION 1..1073: note = derived and/or modified protein sequence (wt) from SFTSV(ZJZHSH-FDE/China/06/2012)__KR017859.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2444 - protein, 1073 aa, synthetic construct
  REGION 1..1073: note = derived and/or modified protein sequence (wt) from SFTSV(ZJZHSH-FZHR/China/07/2013)__KR017862.1__GP
MMKVIWFSSLICLVIQCGGDTGPIICAGPIHSNKRAGIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDVCKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2445 - protein, 1073 aa, synthetic construct
  REGION 1..1073: note = derived and/or modified protein sequence (wt) from SFTSV(ZJZHSH-HCY/China/06/2012)__KR017855.1__GP
MMKVIWFPSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLFMSLFKLGTKQVFRSRTKLA

SEQ ID NO: 2446 - protein, 1073 aa, synthetic construct
  REGION 1..1073: note = derived and/or modified protein sequence (wt) from SFTSV(ZJZHSH-HYC/China/05/2012)__KR017847.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENRKGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2447 - protein, 1073 aa, synthetic construct
  REGION 1..1073: note = derived and/or modified protein sequence (wt) from SFTSV(ZJZHSH-HYJ/China/07/2012)__KR017852.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKVKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2448 - protein, 1073 aa, synthetic construct
  REGION 1..1073: note = derived and/or modified protein sequence (wt) from SFTSV(ZJZHSH-LU/China/10/2011)__KR017850.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDMCKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2449 - protein, 1073 aa, synthetic construct
  REGION 1..1073: note = derived and/or modified protein sequence (wt) from SFTSV(ZJZHSH-SHZ/China/05/2012)__KR017848.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHGYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2450 - protein, 1073 aa, synthetic construct
  REGION 1..1073: note = derived and/or modified protein sequence (wt) from SFTSV(ZJZHSH-WSH/China/08/2012)__KR017854.1__GP
MMKVIWFSSLICLVIQCGGDTGPIICAGPIHSNKSAGIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDVCKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVQKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIMKKLMRSVSCLMGKLMDRGRQVIHEEIGENREGNQDDVRIEMVRPRRVRHWMYSPVILTILAIGLTEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2451 - protein, 1073 aa, synthetic construct
  REGION 1..1073: note = derived and/or modified protein sequence (wt) from SFTSV(ZJZHSH-XAM/China/06/2012)__KR017853.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2452 - protein, 1073 aa, synthetic construct
  REGION 1..1073: note = derived and/or modified protein sequence (wt) from SFTSV(ZJZHSH-YJX/China/06/2012)__KR017860.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASDAKCRCSLVHKPGEVVVSYGGMRVRPKCYGFSRMMATLEVNPPEQRIGQCTGCHLECINGGVRLITLTSELRSATVCASHFCSSATSGKKSTEIQFHSGSLVGKTTIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQASGNMKECVTTGRALLPAVNPGQEACLHFTAPGSPDSKCLKIKVKRINLKCKKSSSYFVLDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEVTATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVLTGANIPSPTDWLNALFGNGLSKWILGVIGVLLGGLALFFLIMSLFKLGTKQIFRSRTKLA

SEQ ID NO: 2453 - protein, 1073 aa, synthetic construct
  REGION 1..1073: note = derived and/or modified protein sequence (wt) from SFTSV(SPL003A)__AB817988.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNSPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2454 - protein, 1073 aa, synthetic construct
  REGION 1..1073: note = derived and/or modified protein sequence (wt) from SFTSV(SPL004A)__AB817989.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECISGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIMKKLMRSVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKEDETAFSVLEGVHSYTVSLSFDHAVVDEQCQLNCGGHESHVTLKGNLIFLDVPKFVDGSYMQTYHSSVPTGANIPSPTDWLNALFGNGLSRWILGVMGVLLGGLALFFLIMSLFKLGTKQVFRSRTKLA

SEQ ID NO: 2455 - protein, 1073 aa, synthetic construct
  REGION 1..1073: note = derived and/or modified protein sequence (wt) from SFTSV(SPL005A)__AB817990.1__GP
MMKVIWFSSLICLVIQCSGDASPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPLDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPLEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGGGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2456 - protein, 1073 aa, synthetic construct
  REGION 1..1073: note = derived and/or modified protein sequence (wt) from SFTSV(SPL010A)__AB817991.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNSPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITTIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2457 - protein, 1073 aa, synthetic construct
  REGION 1..1073: note = derived and/or modified protein sequence (wt) from SFTSV(SPL030A)__AB817992.1__GP
MMKVIWFSSLICLVIQCSGDTSPIICAGPIHSNKSASIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPLDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPELRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGGGNMKECVTTGRALLPAVNPGQEACLHFTAPGSPDSKCLKIRVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCNSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2458 - protein, 1073 aa, synthetic construct
  REGION 1..1073: note = derived and/or modified protein sequence (wt) from SFTSV(SPL053A)__AB985292.1__GP
MMKVIWFSSLICLVIQCSGDTGPIICAGPIHSNKGANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCISDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNSPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2459 - protein, 1073 aa, synthetic construct
  REGION 1..1073: note = derived and/or modified protein sequence (wt) from SFTSV(SPL054A)__AB985293.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFMELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENGEGNQDDVRIEIARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPRFVDGSYMQTYHSSVPTGANIPSPTDWLNALFGNGLSRWILGVIGVLLGGLALFFLIMSLFKLGTKQVFRSRTKLA

SEQ ID NO: 2460 - protein, 1073 aa, synthetic construct
  REGION 1..1073: note = derived and/or modified protein sequence (wt) from SFTSV(SPL055A)__AB985294.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNSPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEVARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2461 - protein, 1073 aa, synthetic construct
  REGION 1..1073: note = derived and/or modified protein sequence (wt) from SFTSV(SPL057A)__AB985295.1__GP
MMKVIWFSSLICLVIQCSGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICRIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECVNGGVRLITLTSELKSATVCASHFCSSAISGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIMKKLMRSVSCLMGKLMDRGRQVIHEEIGENREGNQDDVRIEMARPRRVRHWMYSPVILTILAVGLAEGCDEMVHADSKLVSCKQGSGNMKECVTTGRALLPAVNPGQEACLHFTAPGSPDSKCLKIKVKKINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2462 - protein, 1073 aa, synthetic construct
  REGION 1..1073: note = derived and/or modified protein sequence (wt) from SFTSV(SPL062A)__AB985297.1__GP
MMKVIWFSSLICLVIRCSGGTGPIICAGPIHSNKSANIPHLLGYSEKICQIDRLIHVSSWLRNHSQFQGYVGQRGGRSQVSYFPAENSYSRWSGLLSPCDADWLGMLVVKKARGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIAILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2463 - protein, 1073 aa, synthetic construct
  REGION 1..1073: note = derived and/or modified protein sequence (wt) from SFTSV(SPL066A)__AB985298.1__GP
MMKVIWFSSLICLVIQCSGDASPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLIRSVSCLMGKLMDRGRQVIHEEIGENGEGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQIFKGVSVTYLGSDMEVSGLTDLCEIEELRSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2464 - protein, 1073 aa, synthetic construct
  REGION 1..1073: note = derived and/or modified protein sequence (wt) from SFTSV(SPL070A)__AB985301.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFMELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSPPEQRIGQCTGCHLECINGGVRLITLTSELKSATVCASHFCSSATSGKKSTEIQFHSGSLVGKTAIHVKGALMDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENGEGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVTGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRPRTKLA

SEQ ID NO: 2465 - protein, 1073 aa, synthetic construct
  REGION 1..1073: note = derived and/or modified protein sequence (wt) from SFTSV(SPL071A)__AB985302.1__GP
MMKVIWFSSLICLIIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEETSEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILAILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2466 - protein, 1073 aa, synthetic construct
  REGION 1..1073: note = derived and/or modified protein sequence (wt) from SFTSV(SPL077A)__AB985304.1__GP
MMKVIWFSSLICLVTQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAILKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSSIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKQGTKQVFRSRTKLA

SEQ ID NO: 2467 - protein, 1073 aa, synthetic construct
  REGION 1..1073: note = derived and/or modified protein sequence (wt) from SFTSV(SPL084A)__AB985307.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYTGLMLLTNVLKAIGVWGSWVIAPVKLMFAILKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVQEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2468 - protein, 1073 aa, synthetic construct
  REGION 1..1073: note = derived and/or modified protein sequence (wt) from SFTSV(SPL086A)__AB985308.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2469 - protein, 1073 aa, synthetic construct
  REGION 1..1073: note = derived and/or modified protein sequence (wt) from SFTSV(SPL087A)__AB985309.1__GP
MMKVIWFSSLICLVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRSESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDTQFCKVAGCEHGEEASEAKCRCSLVHKPGEVVVSYGGMRVRPKCYGFSRMMATLEVSPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLMGKLMDRGRQVIHEEIGENREGNRDDIRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDERCQLNCGGHESQVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2470 - protein, 1073 aa, synthetic construct
  REGION 1..1073: note = derived and/or modified protein sequence (wt) from SFTSV(SPL090A)__AB985311.1__GP
MMKVIWFPSLICLVIRCSGGTGPIICAGPIHSNKSANIPHLLGYSEKICQIDRLIHVSSWLRNHSQFQGYVGQRGGRSQVSYFPAENSYSRWSGLLSPCDADWLGMLVVKKARGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIAILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2471 - protein, 1073 aa, synthetic construct
  REGION 1..1073: note = derived and/or modified protein sequence (wt) from SFTSV(SPL097A)__AB985312.1__GP
MMKVIWFSSLICLVIQCSGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKQGTGPCPESEEKTCKTSGSCRGDMQFCKVAGCEHGEEASEAKCRCSLVHKPGEVVVSYGGMRVRPKCYGFSRMMATLEVNPPEQRIGQCTGCHLECVNGGVRLITLTSELKSATVCASHFCSSATSGKKNTEIQFHSGSLVGKTAIHVKGALLDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAVGLAEGCDEMVHADSKLVSCKQGSGNMKECVTTGRALLPAVNPGQEACLHFTAPGSPDSKCLKIKVKKINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2472 - protein, 1073 aa, synthetic construct
  REGION 1..1073: note = derived and/or modified protein sequence (wt) from SFTSV(SPL100A)__AB985313.1__GP
MMKVIWFSSLICLVIQCSGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKQGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECVNGGVRLITLTSELKSATVCASHFCSSATSGKKSTEIQFHSGSLVGKTAIHVKGALLDGTEFTFEGSCMFPDGCDAVDCTFCREFLKNPQCYPAKKWLFIIIVILLGYAGLMLLTNVLKAIAVWGSWVIAPVKLMFAIIKKLMRSVSCLMGKLMDRGRQVIHEEIGENREGNQDDVRIEMARPRRVRHWMYSPVILTVLAVGLAEGCDEMVHADSKLVSCKQGSGNMKECVTTGRALLPAVNPGQEACLHFTAPGSPDSKCLKIKVKKINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSNKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2473 - protein, 1073 aa, synthetic construct
  REGION 1..1073: note = derived and/or modified protein sequence (wt) from SFTSV(SPL106A)__AB985316.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAILKKLMRSVSCLMGKLMDRGRQVIHEEIGENREGNQDDVRIEMARPRRVRHWMYSPVILTILAIGLAEGCDEVVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMIGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFSLIMSLFKLGTKQVLRSRTKLA

SEQ ID NO: 2474 - protein, 1073 aa, synthetic construct
  REGION 1..1073: note = derived and/or modified protein sequence (wt) from SFTSV(SPL117A)__AB985321.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYRGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2475 - protein, 1073 aa, synthetic construct
  REGION 1..1073: note = derived and/or modified protein sequence (wt) from SFTSV(SPL120A)__AB985322.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAILKKLMRSVSCLMGKLMDRGRQVIHEEIGENREGNQDDVRIEMARPRRVRHWMYSPVILTILAIGLAEGCDEVVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFSLIMSLFKLGTKQVFRSRTKLA

SEQ ID NO: 2476 - protein, 1073 aa, synthetic construct
  REGION 1..1073: note = derived and/or modified protein sequence (wt) from SFTSV(SPL121A)__AB985323.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSPKDFVCYKEGTGPCSESEEKTCKTSGSCRGDMQFCKVAGCEHGEEASEAKCRCSLVHKPGEVVVSYGGMRVRPKCYGFSRMMATLEVNSPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKVKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEMEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2477 - protein, 1073 aa, synthetic construct
  REGION 1..1073: note = derived and/or modified protein sequence (wt) from SFTSV(SPL124A)__AB985324.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNSPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIRVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIISLFKLGTKQVFRSRTKLA

SEQ ID NO: 2478 - protein, 1073 aa, synthetic construct
  REGION 1..1073: note = derived and/or modified protein sequence (wt) from SFTSV(SPL128A)__AB985325.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNSPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRSVSCLMGKLMDRGRQVIHEEIGENREGNQDDVRIEMARPRRVRHWMYSPVILTILAIGLAEGCDEMVHADSKLVSCKQGSGNMKECVTTGRALLPAVNPGQEACLHFTAPGSPDSKCLKIRVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGARVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGAIGVLLGGLALFFLIISLFKLGTKQVFRSRTKLA

SEQ ID NO: 2479 - protein, 1073 aa, synthetic construct
  REGION 1..1073: note = derived and/or modified protein sequence (wt) from SFTSV(SPL129A)__AB985326.1__GP
MMKVIWFSSLICLVIQCSGDTGPIICAGPIHSNKSANIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECISGGVRLITLTSELKSATVCASHFCSSATSGKKSTEIQFHSGSLVGKAAIHVKGALVDGTEFTFEGSCMFPDGCDAVDCTFCREFLKNPQCYPAKKWLFIIIVILLGYAGLMLLTNVLKAIGVWGSWVIAPVKLMFAIMKKLMRSVSCLMGKLMDRGRQVIHEEIGENREGNRDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVETVANYSAIPTTIGGLRFERSHDSQGKISGSPLDITAIRGSFSVNYRGLRLSLSEITATCTGEVTNVSGCYSCMTGAKVSIKLHSSKNSTAHVRCKEDETAFSVLEGVHSYTVSLSFDHAVVDEQCQLNCGGHESHVTLKGNLIFLDVPKFVDGSYMQTYHSSVPTGANIPSPTDWLNALFGNGLSRWILGVMGVLLGGLALFFLIMSLFKLGTKQVFRSRTKLA

SEQ ID NO: 2480 - protein, 1073 aa, synthetic construct
  REGION 1..1073: note = derived and/or modified protein sequence (wt) from SFTSV(YG1)__AB817987.1__GP
MMKVIWFSSLICLVIQCSGDTGPIICAGPIHSNKSANIPHLLGYSEKICQIDRLIHVSSWLRNHSQFQGYVGQRGGRSQVSYFPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCESESLPQPFDVAWMDVGHSHKIIMREHKTKWVQESSSKDFVCYKEGTGPCSESEEKTCKTSGSCRGDMQFCKVAGCEHGEETSEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRSVSCLMGKLMDRGRQVIHEEIGENREGNQEDVRIEMARPRRVRHWMYSPVILAILAIGLAEGCDEMVHADSKLVSCKQGSGNMKECVTTGRALLPAVNPGQEACLHFTAPGSPDSKCLKIKVKRINLKCKKSSSYFVPDARSRCTSVRRCRWAGDCQSGCPSHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSSVPTGANIPSPTDWLNALFGNGLSRWILGVIGVLLGGLALFFLIMSLFKLGTKQVFRSRTKLA

SEQ ID NO: 2481 - protein, 1073 aa, synthetic construct
  REGION 1..1073: note = derived and/or modified protein sequence (wt) from SFTSV(SDTA_1)__KX641913.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKARESDMIVPGPSYKGKVFFERPTFDGYVGWGCGSGKSRTESGELCSSDSGTSSGLLPSDRVLWIGDVACQLMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEETSEAKCRCSLVHKPGEVVVSYGGMRVRPKCYGFSRMMATLEVNPPEQRIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEIARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2482 - protein, 1073 aa, synthetic construct
  REGION 1..1073: note = derived and/or modified protein sequence (wt) from SFTSV(SDTA_2)__KX641914.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEHMIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2483 - protein, 1073 aa, synthetic construct
  REGION 1..1073: note = derived and/or modified protein sequence (wt) from SFTSV(SDTA_3)__KX641915.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEVARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2484 - protein, 1073 aa, synthetic construct
  REGION 1..1073: note = derived and/or modified protein sequence (wt) from SFTSV(SDTA_4)__KX641916.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCIFPDGCDAVDCTFCREFLKNPQCYPAKKWLFIIIVILLGYAGLMLLTNVLKAIGVWGSWVIAPVKLIFAIMKKLMRTVSCLVGKLMDRGRQVIHEEIGENGEGNQDDVRIEMARPRRVRHWMYSPVILTILAIGLAEGCDEMVHADSKLVSCRQGSGNMKECITTGGALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2485 - protein, 1073 aa, synthetic construct
  REGION 1..1073: note = derived and/or modified protein sequence (wt) from SFTSV(HBGS13_human_2015)__KY440773.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGIAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFIIIMSLFKLGTKQVFRSRTKLA

SEQ ID NO: 2486 - protein, 1073 aa, synthetic construct
  REGION 1..1073: note = derived and/or modified protein sequence (wt) from SFTSV(HBMC16_human_2015)__KY440776.1__GP
MMKVIWFSSLVCLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKAAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2487 - protein, 1073 aa, synthetic construct
  REGION 1..1073: note = derived and/or modified protein sequence (wt) from SFTSV(HBMC5_human_2016)__KY440770.1__GP
MMKVIWFSSLVCLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKGSDMIVPGPSYKGKVLFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKAAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2488 - protein, 1073 aa, synthetic construct
  REGION 1..1073: note = derived and/or modified protein sequence (wt) from SFTSV(HB29)__KP202164.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVIHLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNNTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2489 - protein, 1073 aa, synthetic construct
  REGION 1..1073: note = derived and/or modified protein sequence (wt) from SFTSV(HNXY_115)__KC292312.1__GP
MMKVIWFSSLIYFVIQCSGDSGSIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2490 - protein, 1073 aa, synthetic construct
  REGION 1..1073: note = derived and/or modified protein sequence (wt) from SFTSV(HNXY_144)__KC292307.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2491 - protein, 1073 aa, synthetic construct
  REGION 1..1073: note = derived and/or modified protein sequence (wt) from SFTSV(HNXY_157)__KC292305.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2492 - protein, 1073 aa, synthetic construct
  REGION 1..1073: note = derived and/or modified protein sequence (wt) from SFTSV(HNXY_170)__KC292304.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQITLKGNLIFLDVPKFVDGSYMQTYHSTVPTGANIPSPTDWLNALFGNGLSRWVLGVIGVLLGGLALFFMIMSLFKLGTKQVFRSRTKLA

SEQ ID NO: 2493 - protein, 1073 aa, synthetic construct
  REGION 1..1073: note = derived and/or modified protein sequence (wt) from SFTSV(HNXY_174)__KC292306.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICRIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGMSRWILGVMGVLLGGLALFFMIMSLFKLGTKQVFRSRTKLA

SEQ ID NO: 2494 - protein, 1073 aa, synthetic construct
  REGION 1..1073: note = derived and/or modified protein sequence (wt) from SFTSV(HNXY_182)__KC292324.1__GP
MMKVIWFSSLICFVIQCSGDSGPIICAGPIHSNKSADIPHLQGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGLIGVLLGGLALFFMIMSLFKLGTKQVFRSRTKLA

SEQ ID NO: 2495 - protein, 1073 aa, synthetic construct
  REGION 1..1073: note = derived and/or modified protein sequence (wt) from SFTSV(HNXY_188)__KC292301.1__GP
MMKVIWFSSLICLVIQCGGGTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2496 - protein, 1073 aa, synthetic construct
  REGION 1..1073: note = derived and/or modified protein sequence (wt) from SFTSV(HNXY_191)__KC292323.1__GP
MMKVIWFSSLICLVIQCGGDTGPIICAGPTHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2497 - protein, 1073 aa, synthetic construct
  REGION 1..1073: note = derived and/or modified protein sequence (wt) from SFTSV(HNXY_195)__KC292326.1__GP
MMKVIWFSSLICFVIQCSGDSGPIICAGPIHSNKSADIPHLQGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2498 - protein, 1073 aa, synthetic construct
  REGION 1..1073: note = derived and/or modified protein sequence (wt) from SFTSV(HNXY_2)__KC292318.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGMSRWILGVIGVLLGGLALFFMIMSLFKLGTKQVFRSRTKLA

SEQ ID NO: 2499 - protein, 1073 aa, synthetic construct
  REGION 1..1073: note = derived and/or modified protein sequence (wt) from SFTSV(HNXY_202)__KC292325.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKKINLKCKRSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2500 - protein, 1073 aa, synthetic construct
  REGION 1..1073: note = derived and/or modified protein sequence (wt) from SFTSV(HNXY_206)__KC292302.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPTKKWLFIIIVILLGYAGLMLLTNVLKAIGVWGSWVIAPVKLVFAIIKKLMRAVSCLMGKLMDRGRQVIHEEIGENREGNQDDIRIEMARPRRVRHWMYSPVILTILAIGLAEGCDEMVHADSKLVSCRQGSGNMKECVTTGRALLPAVNPGQEACLHFTTPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2501 - protein, 1073 aa, synthetic construct
  REGION 1..1073: note = derived and/or modified protein sequence (wt) from SFTSV(HNXY_207)__KC292315.1__GP
MMKVIWFPSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2502 - protein, 1073 aa, synthetic construct
  REGION 1..1073: note = derived and/or modified protein sequence (wt) from SFTSV(HNXY_224)__KC292317.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIVVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTILAIGLTESCDEMVHADSKLVSCRQGSGNMKECVTTGRALLPAVNPGQEACLHFTAPGSPDSKCLKIKVKRINLKCKKSSSYFVPDARSRCTSVRRCRWAGDCESGCPPHFTSNSFSDDWAGKMDRAGLGFSGCSDGCGGAACGCFNAAPSCIFWRKWVENPHGIIWKVSPCAAWVPSAVIELTMPSGEVRTFQPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2503 - protein, 1073 aa, synthetic construct
  REGION 1..1073: note = derived and/or modified protein sequence (wt) from SFTSV(HNXY_231)__KC292313.1__GP
MMKVIWFSSLICFVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2504 - protein, 1073 aa, synthetic construct
  REGION 1..1073: note = derived and/or modified protein sequence (wt) from SFTSV(HNXY_245)__KC292320.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTISLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2505 - protein, 1073 aa, synthetic construct
  REGION 1..1073: note = derived and/or modified protein sequence (wt) from SFTSV(HNXY_262)__KC292309.1__GP
MMKVIWFSSLICFVIQCSGDSGPIICAGPIHSNKSADIPHLLGYSEKICQIDRLIHVSSWLRNHSQFQGYVGQRGGRSRVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELRSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2506 - protein, 1073 aa, synthetic construct
  REGION 1..1073: note = derived and/or modified protein sequence (wt) from SFTSV(HNXY_278)__KC292322.1__GP
MMKVIWFSSLICLVIQCGGDTGPIICAGPTHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTGGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMIHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTPNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2507 - protein, 1073 aa, synthetic construct
  REGION 1..1073: note = derived and/or modified protein sequence (wt) from SFTSV(HNXY_31)__KC292310.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2508 - protein, 1073 aa, synthetic construct
  REGION 1..1073: note = derived and/or modified protein sequence (wt) from SFTSV/FTLSV(2011YGS5)__KF711925.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARNRCTSVRRCRWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2509 - protein, 1073 aa, synthetic construct
  REGION 1..1073: note = derived and/or modified protein sequence (wt) from SFTSV/FTLSV(2011YGS7)__KF711922.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFYQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPSVNPGQEACLHFTAPGSPDSKCLKIKVKRINLKCKKSSSYFVPDARNRCTSVRRCRWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2510 - protein, 1073 aa, synthetic construct
  REGION 1..1073: note = derived and/or modified protein sequence (wt) from SFTSV/FTLSV(2011YPQ11)__KF711926.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPSVNPGQEACLHFTAPGSPDSKCLKIKVKRINLKCKKSSSYFVPDARYRCTSVRRCPWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGMSRWILGVIGVLLGGLALFFLIMFLFKLGTKQVFRSRTKLA

SEQ ID NO: 2511 - protein, 1073 aa, synthetic construct
  REGION 1..1073: note = derived and/or modified protein sequence (wt) from SFTSV/FTLSV(2011YPQ12)__KF711930.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPVARYRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2512 - protein, 1073 aa, synthetic construct
  REGION 1..1073: note = derived and/or modified protein sequence (wt) from SFTSV/FTLSV(2011YPQ17)__KF711923.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNALDCTFCREFLKNPHCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPSVNPGQEACLHFTAPGSPDSKCLKIKVKRINLKCKKSSSYFVPDARNRCTSVRRCRWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2513 - protein, 1073 aa, synthetic construct
  REGION 1..1073: note = derived and/or modified protein sequence (wt) from SFTSV/FTLSV(2011YSC22)__KF711927.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPSVNPGQEACLHFTAPGSPDSKCLKIKVKRINVKCKKSSSYFVPDARNRCTSVRRCRWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALLGNGMSRWILGVIGVLLGGLALFFLIMFLFKLGTKQVFRSRTKLA

SEQ ID NO: 2514 - protein, 1073 aa, synthetic construct
  REGION 1..1073: note = derived and/or modified protein sequence (wt) from SFTSV/FTLSV(2011YSC60)__KF711945.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREYKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARNRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2515 - protein, 1073 aa, synthetic construct
  REGION 1..1073: note = derived and/or modified protein sequence (wt) from SFTSV/FTLSV(2011YSH45)__KF711947.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLECKKSSSYFVPDARNRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSRNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2516 - protein, 1073 aa, synthetic construct
  REGION 1..1073: note = derived and/or modified protein sequence (wt) from SFTSV/FTLSV(2011YSH52)__KF711928.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGFMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINKKCKKSSSYFVPDARYRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLSDLCEIEELNSKKLALAPCNQAGMGVVGKVGEIQCSSEESARTIKKDGCIRNADLVGIEVRVDDAVFYFKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLILSLFKLGTKQIFRSRTKLA

SEQ ID NO: 2517 - protein, 1073 aa, synthetic construct
  REGION 1..1073: note = derived and/or modified protein sequence (wt) from SFTSV/FTLSV(2011YXX9)__KF711924.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQWEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPSVNPGQEACLHFTAPGSPDSKCLKIKVKRINLKCKKSSSYFVPDARNRCTSVRRCRWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2518 - protein, 1073 aa, synthetic construct
  REGION 1..1073: note = derived and/or modified protein sequence (wt) from SFTSV/FTLSV(2012YGS10)__KF711937.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTVLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2519 - protein, 1073 aa, synthetic construct
  REGION 1..1073: note = derived and/or modified protein sequence (wt) from SFTSV/FTLSV(2012YGS4)__KF711933.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGIPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2520 - protein, 1073 aa, synthetic construct
  REGION 1..1073: note = derived and/or modified protein sequence (wt) from SFTSV/FTLSV(2012YSC6)__KF711931.1__GP
MMKVIWFSSLICFVIQCSGGSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPIDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2521 - protein, 1073 aa, synthetic construct
  REGION 1..1073: note = derived and/or modified protein sequence (wt) from SFTSV/FTLSV(2012YSH10)__KF711940.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSAMSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2522 - protein, 1073 aa, synthetic construct
  REGION 1..1073: note = derived and/or modified protein sequence (wt) from SFTSV/FTLSV(2012YSH104)__KF711943.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCRKFLKNPQCYPAKKWLFIIIVILLGYAGLMLLTNVLKAIGIWGSWVIAPVKLIFAIIKKLTRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARYRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2523 - protein, 1073 aa, synthetic construct
  REGION 1..1073: note = derived and/or modified protein sequence (wt) from SFTSV/FTLSV(2012YSH105)__KF711944.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSGDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2524 - protein, 1073 aa, synthetic construct
  REGION 1..1073: note = derived and/or modified protein sequence (wt) from SFTSV/FTLSV(2012YSH107)__KF711942.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTGKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARYRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2525 - protein, 1073 aa, synthetic construct
  REGION 1..1073: note = derived and/or modified protein sequence (wt) from SFTSV/FTLSV(2012YSH14)__KF711938.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECIIGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2526 - protein, 1073 aa, synthetic construct
  REGION 1..1073: note = derived and/or modified protein sequence (wt) from SFTSV/FTLSV(2012YSH16)__KF711934.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARYRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2527 - protein, 1073 aa, synthetic construct
  REGION 1..1073: note = derived and/or modified protein sequence (wt) from SFTSV/FTLSV(2012YSH6)__KF711921.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWNGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLVTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2528 - protein, 1073 aa, synthetic construct
  REGION 1..1073: note = derived and/or modified protein sequence (wt) from SFTSV/FTLSV(2012YSH86)__KF711939.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCHGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVLRSRTKLA

SEQ ID NO: 2529 - protein, 1073 aa, synthetic construct
  REGION 1..1073: note = derived and/or modified protein sequence (wt) from SFTSV/FTLSV(2012YSH89)__KF711935.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDEAAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2530 - protein, 1073 aa, synthetic construct
  REGION 1..1073: note = derived and/or modified protein sequence (wt) from SFTSV/FTLSV(2012YSH9)__KF711919.1__GP
MMKVIWFSSLICLVIQCSGDSGPIICAGPIHSNKSAGIPHLLGYSEKICQIDRLIHVSSWLRNHSQFQGYVGQRGGRSRVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNRPEQRIGQCTGCHLECINGGVRLITLTSELRSATVCASHFCSSATSGKKNTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2531 - protein, 1073 aa, synthetic construct
  REGION 1..1073: note = derived and/or modified protein sequence (wt) from SFTSV/FTLSV(2012YSH91)__KF711920.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIHEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEKASETKCRCSLVHKPGEVVVSYGGMRVRPKCYGISRMMATLEVNPPEQRIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINIKCKKSSSYFVRDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEKQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2532 - protein, 1073 aa, synthetic construct
  REGION 1..1073: note = derived and/or modified protein sequence (wt) from SFTSV/FTLSV(2012YSH92)__KF711941.1__GP
MMKVIWFSSLICFVIQCSGDSGPIICAGPIHSNKSADIPHLLGYSEKICQIDRLIHVSSWLRNHSQFQGYVGQRGGRSQVSYYPAENSHSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLRIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2533 - protein, 1073 aa, synthetic construct
  REGION 1..1073: note = derived and/or modified protein sequence (wt) from SFTSV/FTLSV(2012YSH93)__KF711946.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSNRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLTRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARYRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWVLGVMGVLLGGLALFFMIMSLFKLGTKQVFRSRTKLA

SEQ ID NO: 2534 - protein, 1073 aa, synthetic construct
  REGION 1..1073: note = derived and/or modified protein sequence (wt) from SFTSV/FTLSV(YGS1)__KF356537.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPSVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2535 - protein, 1073 aa, synthetic construct
  REGION 1..1073: note = derived and/or modified protein sequence (wt) from SFTSV/FTLSV(YNY1)__KF356538.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILFGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2536 - protein, 1073 aa, synthetic construct
  REGION 1..1073: note = derived and/or modified protein sequence (wt) from SFTSV/FTLSV(YPQ133)__KF356530.1__GP
MMKVIWFSSLICFVIQCSGDSSPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSQKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGVIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2537 - protein, 1073 aa, synthetic construct
  REGION 1..1073: note = derived and/or modified protein sequence (wt) from SFTSV/FTLSV(YPQ2)__KF356531.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKIAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPMARFRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQVKISGSPLDITAMRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2538 - protein, 1073 aa, synthetic construct
  REGION 1..1073: note = derived and/or modified protein sequence (wt) from SFTSV/FTLSV(YPQ5)__KF356532.1__GP
MMKVIWFSSLICFVIQCSGDSGPIICAGPIHSNKSADIPHLLGYSEKICQIDRLIHVSSWLRNHSQFQGYVGQRGGRSRVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPVARYRCTSVRRCRWAGDCQSGCPPHFTSNSFSNDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSYMEVSGLTDLCEIEELRSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVMGVLLGGLALFFMIMSLFKLGTKQVFRSRTKLA

SEQ ID NO: 2539 - protein, 1073 aa, synthetic construct
  REGION 1..1073: note = derived and/or modified protein sequence (wt) from SFTSV/FTLSV(YSC19)__KF356536.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATMEVNPPEQRIGQCTGCHLECINGGVRLITLTSELKSATVCASHFCSSATSGKKSTEIHFHSGSLVGKTAIHVKGALVDGTEFTFEGSCMFPDGCNAVDCTFCREFLKNPQCYPAKKWLFIIIVILLGYAGLMLLTNVLKAIGVWGSWVIAPVKLMFAIMKKLMRTVSCLVGKLMDRGRQVIHEEIGENGEGNHDDVRIEMARPRRVRHWMYSPVILTILAIGLAEGCDEMVHADSKLVSCRQGSGNMKECVTTGRALLPSVNPGQEACLHFTAPGSPDSKCLKIKVKRINLKCKKSSSYFVPIARNRCTSVRRCRWAGDCQSGCPPHFTSNSFSDDWAGKMDRAGLGFSGCSDGCGGAACGCFNAAPSCIFWRKWVENSHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLFKLGTKQVFRSRTKLA

SEQ ID NO: 2540 - protein, 1073 aa, synthetic construct
  REGION 1..1073: note = derived and/or modified protein sequence (wt) from SFTSV/FTLSV(YSC3)__KF356535.1__GP
MMKVIWFSSLVCLVIQCSGDSGPIICAGPIHSNKSAAIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRIRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSYDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2541 - protein, 1073 aa, synthetic construct
  REGION 1..1073: note = derived and/or modified protein sequence (wt) from SFTSV/FTLSV(YSH39)__KF356529.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFMELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGHAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2542 - protein, 1073 aa, synthetic construct
  REGION 1..1073: note = derived and/or modified protein sequence (wt) from SFTSV/FTLSV(YSHX002)__KF356540.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWNGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLVTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEKQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2543 - protein, 1073 aa, synthetic construct
  REGION 1..1073: note = derived and/or modified protein sequence (wt) from SFTSV/FTLSV(YXX2)__KF356534.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDYAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2544 - protein, 1073 aa, synthetic construct
  REGION 1..1073: note = derived and/or modified protein sequence (wt) from SFTSV/Huaiyangshan virus(2010-FQM)__HQ419236.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKASGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMFLFKLGTKQIFRSRTKLA

SEQ ID NO: 2545 - protein, 1073 aa, synthetic construct
  REGION 1..1073: note = derived and/or modified protein sequence (wt) from SFTSV/Huaiyangshan virus(2010-LZR)__HQ419237.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWIPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2546 - protein, 1073 aa, synthetic construct
  REGION 1..1073: note = derived and/or modified protein sequence (wt) from SFTSV/Huaiyangshan virus(2010-T112)__HQ419238.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPVQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYAPVILTILAMGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCVAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2547 - protein, 1073 aa, synthetic construct
  REGION 1..1073: note = derived and/or modified protein sequence (wt) from SFTSV/Huaiyangshan virus(2010-WJ)__HQ419229.1__GP
MMKVIWFSSLICFVIQCSGDSGPIICAGPIHSNKSADIPHLLGYSEKICQIDRLIHVSSWLRNHSQFQGYVGKRGGRSQVSYYLAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTPNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2548 - protein, 1073 aa, synthetic construct
  REGION 1..1073: note = derived and/or modified protein sequence (wt) from SFTSV/Huaiyangshan virus(2010-WJQ)__HQ419230.1__GP
MMKVIWFSSLICLVIQCGGDTGPIICAGPTHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSGCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2549 - protein, 1073 aa, synthetic construct
  REGION 1..1073: note = derived and/or modified protein sequence (wt) from SFTSV/Huaiyangshan virus(2010-WSQ)__HQ419235.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEERACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLIGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEDCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFEKSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2550 - protein, 1073 aa, synthetic construct
  REGION 1..1073: note = derived and/or modified protein sequence (wt) from SFTSV/Huaiyangshan virus(2010-WWG)__HQ419231.1__GP
MMKVIWFSTLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFPRMMATLEVNQPEQRIGQCTGCHLECINGGVRLITLTSELRSATVCASHFCSSATSGKKSTEIQFHSGSLVGKTAIHVKGALVDGTEFTFEGSCMFPDGCDAVDCTFCREFLKNPQCYPAKKWLLIIIVILLGYAGLMLLTNVLKAIGIWGSWVIAPVKLIFAIIKKLMRAVSCLMGKLMDRGRQVIHEGIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2551 - protein, 1073 aa, synthetic construct
  REGION 1..1073: note = derived and/or modified protein sequence (wt) from SFTSV/Huaiyangshan virus(2010-WWX)__HQ419232.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCLLECINGGVRLITLTSELKSATVCASHFCSSATSGKKSTEIQFHSGSLVGKTAIHVKGALIDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2552 - protein, 1073 aa, synthetic construct
  REGION 1..1073: note = derived and/or modified protein sequence (wt) from SFTSV/Huaiyangshan virus(2010-ZGQ)__HQ419233.1__GP
MMKVIWFSSLICLVIQCGGDTGPIICAGPTHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVSQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIVVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQIFRSRTKLA

SEQ ID NO: 2553 - protein, 1073 aa, synthetic construct
  REGION 1..1073: note = derived and/or modified protein sequence (wt) from SFTSV/Huaiyangshan virus(M-HZM)__JF951393.1__GP
MMKVIWFSSLTCLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKNTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNLRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2554 - protein, 1073 aa, synthetic construct
  REGION 1..1073: note = derived and/or modified protein sequence (wt) from SFTSV/Phlebovirus(AH15/China/2010 strain AH15)__HQ141593.1__GP
MMKVIWFFSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMGVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNEPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAMGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSINYRGLRLSLTEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2555 - protein, 1073 aa, synthetic construct
  REGION 1..1073: note = derived and/or modified protein sequence (wt) from SFTSV/Phlebovirus(HN6/China/2010 strain HN6)__HQ141596.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLVGKLMDRGRQVIHEEIGENREGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEMRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGATVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2556 - protein, 1073 aa, synthetic construct
  REGION 1..1073: note = derived and/or modified protein sequence (wt) from SFTSV/Phlebovirus(JN1/China/2010)__JN258706.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPNICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLVTLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLKGVHSYIVSLSFDHAVVDEQCQLNCGGHESQVTLKGNLIFLDVPIFVDGSYMQTYHSTVPTGANIPSPTDWLNALFGNGLSRWILGVIGVLLGGLALFFLIMFLLKLGTKQVFRSRTKLA

SEQ ID NO: 2557 - protein, 1073 aa, synthetic construct
  REGION 1..1073: note = derived and/or modified protein sequence (wt) from SFTSV/Phlebovirus(JS2010-014)__JQ317170.1__GP
MMKVIWFSYLICFVIQCSGDSGPIIWAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRIRPKCYGFSRMMATLEVSQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENRVGNQDDVRIEMARPRRVRHWMYSPVILTILAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2558 - protein, 1073 aa, synthetic construct
  REGION 1..1073: note = derived and/or modified protein sequence (wt) from SFTSV/Phlebovirus(JS2010-015)__JQ317173.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCNAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTFLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2559 - protein, 1073 aa, synthetic construct
  REGION 1..1073: note = derived and/or modified protein sequence (wt) from SFTSV/Phlebovirus(JS2010-019)__JQ317179.1__GP
MMKVIWFSSLTCFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRLGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLMFAIIKKLMRTVSCLMRKLMDRGRQVIHEEIGENREGNQDDVRIEMARPRRVRHWMYSPVILTILAIGLAESCDEMVHADSKLVSCRQGSGNMKECVTTGRALLSAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGGHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2560 - protein, 1073 aa, synthetic construct
  REGION 1..1073: note = derived and/or modified protein sequence (wt) from SFTSV/Phlebovirus(JS24)__HQ830164.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCGGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSKLVSCRQGSGNMKECVTTGRALLPAVNPGQEACLHFTAPGSPDSKCLKIKVKKINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2561 - protein, 1073 aa, synthetic construct
  REGION 1..1073: note = derived and/or modified protein sequence (wt) from SFTSV/Phlebovirus(JS4/China/2010 strain JS4)__HQ141605.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLLFAIIKKLMRTVSCLMGKLMDRGRQVIHEEIGENREGNQDDVRIEMARPRRVRHWMYSPVILTILAIGLAEGCDEMVHADSKLVSCRQGSENMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2562 - protein, 1073 aa, synthetic construct
  REGION 1..1073: note = derived and/or modified protein sequence (wt) from SFTSV/Phlebovirus(JS6)__HQ830170.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNEPEQRIGQCTGCQLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAMGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSINYRGLRLSLSEITATCTGEVTNVSGCYSCMTGAKVSIKLHSSKNSTAHVRCKGDETAFSVLEGVHSYSVSLSFDHAVVDEQCQLNCGGHESQVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2563 - protein, 1073 aa, synthetic construct
  REGION 1..1073: note = derived and/or modified protein sequence (wt) from SFTSV/Phlebovirus(JSD1)__JF267784.1__GP
MMKVIWFSSLICFVIQCSGDSGPIICAGPIHSNKSADIPHLLGYSEKICQIDRLIHVSSWLRNHSQFQGYVGQRGGRSQVSYYPAENSHSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCNAVDCTFCREFLKNPQCYPAKKWLFIIIVILLGYAGLMLLTNVLKAIGIWGSWVIAPVKLMFAIIKKLMRTVSCLMGKLMDRGRQVIHEEIGENREGNQDDVRIEMARPRRVRHWMYSPVILTFLAIGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2564 - protein, 1073 aa, synthetic construct
  REGION 1..1073: note = derived and/or modified protein sequence (wt) from SFTSV/Phlebovirus(LN2/China/2010 strain LN2)__HQ141608.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICRIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPVQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGIWGSWVIAPVKLIFAIIKKLMRTVSCLMGKLMDRGRQVIHEEIGENREGNQDDVRIEMARPRRVRHWMYAPVILTILAMGLAESCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFMIMSLFKLGTKQVFRSRTKLA

SEQ ID NO: 2565 - protein, 1073 aa, synthetic construct
  REGION 1..1073: note = derived and/or modified protein sequence (wt) from SFTSV/Phlebovirus(LN3/China/2010 strain LN3)__HQ141611.1__GP
MMKVIWFSSLICLVIQCGGDTGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNQPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLVFAIIKKLMRAVSCLMGKLMDRGRQVIHEEIGENREGNQDDVRIEMARPRRVRHWMYSPVILTILAIGLAEGCDEMVHADSRLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYSVSLSFDHAVVDEQCQLNCGGHESHVTLRGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2566 - protein, 1073 aa, synthetic construct
  REGION 1..1073: note = derived and/or modified protein sequence (wt) from SFTSV/Phlebovirus(SD24/China/2010 strain SD24)__HM802201.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDIAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 2567 - protein, 1073 aa, synthetic construct
  REGION 1..1073: note = derived and/or modified protein sequence (wt) from SFTSV/Phlebovirus(SD4/China/2010 strain SD4)__HM802203.1__GP
MMKVIWFSSLICFVIQCSGDSGPIICAGPIHSNKSADIPHLLGYSEKICQIDRLIHVSSWLRNHSQFQGYVGQRGGRSQVSYYPAENSYSRWSGLLSPCDADWLGMLVVKKAKGSDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKTCKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELKSATVCASHFCSSATSGKKSTEIQFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLLFAIIKKLMRTVSCLMGKLMDRGRQVIHEEIGENREGNQDDVRIEMARPRRVRHWMYSPVILTILATGLAEGCDEMVHADSKLVSCRQGSGNMKECVTTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCATWVPSAVIELTMPSGEVRTFHPMSGIPTQVFKGVSVTYLGSDMEVSGLTDLCEIEELKSKKLALAPCNQAGMGVIGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYTVSLSFDHAVVDEQCQLNCGGHESQVTLKGNLIFLDVPKFVDGSYMQTYHSTVPTGANIPSPTDWLNALFGNGLSRWILGVIGVLLGGLALFFLIMSLFKLGTKQVFRSRTKLA

SEQ ID NO: 2568 - protein, 1073 aa, synthetic construct
  REGION 1..1073: note = derived and/or modified protein sequence (wt) from SFTSV/Phlebovirus(SDYY104/China/2011)__KU239112.1__GP
MMKVIWFSSLICLVIQCSGDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELNSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGMRVRPKCYGFSRMMATLEVNPPEQRIGQCTGCHLECINGGVRLITLTSELRSATVCASHFCSSATSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVSLSFDHAVVDEQCQLNCGGHESQVTLKGNLIFLDVPKFVDGSYMQTYHSTVPTGANIPSPTDWLNALFGNGLSRWILGVIGVLLGGLALFFLIVFLLKLGTKQAFRSRTKLA

SEQ ID NO: 2569 - RNA, 1287 nt, synthetic construct
  misc_feature 1..1287: note = derived and/or modified CDS sequence (wt) from ANDV(Chile-9717869)__AF291702.1__N
  source 1..1287: mol_type = other RNA
atgagcaccctccaagaattgcaggaaaacatcacagcacacgaacaacagctcgtgactgctcggcaaaagcttaaggatgccgagaaggcagtggaggtggacccggatgacgttaacaagagcacactacaaagtagacgggcagctgtgtctacattggagaccaaactcggagaacttaagaggcaacttgcagatttggtggcagctcaaaaattggctacaaaaccagttgatccaacagggcttgagcctgatgatcatctaaaggaaaaatcatctctgagatatgggaatgtcctggatgttaattcaattgatttggaagaaccgagtggacagactgctgattggaaggctataggagcatacatcttagggtttgcaattccgatcatcctaaaggccttatacatgctgtcaacccgtgggagacaaactgtgaaagacaacaaagggaccaggataaggtttaaggatgattcttcctttgaagaagtcaatgggatacgtaaaccaaaacacctttacgtctcaatgccaactgcacagtccactatgaaggctgaagaaatcacgccaggacgatttaggacaattgcttgtggcctttttccagcacaggtcaaagcccgaaatataataagtcctgtaatgggagtaattggatttggcttctttgtaaaggattggatggatcggatagaagagtttctggctgcagagtgtccattcttacctaagccaaaggtcgcctcagaagccttcatgtctaccaataagatgtattttctgaacagacagagacaagtcaatgaatctaaggttcaagatattatcgatttgatagaccatgctgagaccgagtctgctaccttgtttacagagattgcaacaccccattcagtctgggtgtttgcatgtgcacctgaccggtgccctccaactgcattgtatgttgcaggggtaccggaacttggtgcatttttttctatccttcaggacatgcgtaataccatcatggcatctaaatctgtagggactgcagaagagaagctaaagaaaaaatctgccttctaccaatcatacctaagaaggacacaatctatgggaatccaactggaccagaagatcataatcctttacatgctatcatggggtaaagaagctgtgaatcacttccatcttggtgatgatatggaccctgaactcaggcagctagcacaatctctgatcgatactaaggtgaaggagatctccaaccaagagccacttaagttgtag

SEQ ID NO: 2570 - RNA, 1287 nt, synthetic construct
  misc_feature 1..1287: note = derived and/or modified CDS sequence (wt) from ANDV(Nort)__AF325966.1__N
  source 1..1287: mol_type = other RNA
atgagcaccctccaagaactacaggaaaatatcacagcacacgaacaacagctcgtgactgctcggcaaaagcttaaagatgccgaaaagacggtggaggtggacccggatgaggttaacaagagcacattacaaagtagacgggcagctgtgtctacattggagaccaaactcggagaacttaagaggcagcttgcggatctggtggcagctcaaaaactggctacaaaaccagttgatccaacagggcttgagcctgatgatcatctaaaagagaaatcatctctccgttatgggaatgtcctggatgtcaactccattgatcttgaagagccaagtggtcaaactgctgattggaaagctattggggcctacatattaggatttgccataccaatcatcctgaaagctctctacatgctttccacccgtgggagacagactgtcaaagacaacaaggggactagaataaggttcaaggatgactcatcatttgaagaggtcaacggtatccggaaaccgaagcatctctatgtgtcaatgccaactgcacaatcaacaatgaaggctgaagagataacacctggacggttcaggacaattgcatgtggactcttccctgcacaagtgaaagccaggaacatcatcagcccagtcatgggagtaatcgggtttagcttctttgtgaaggattggatggaaaggattgaggatttcttggcagctgaatgcccattcttacctaaacccaaggcattgtctgaagcattcatggctactaataaagcttatttcctgaataggcaacggcaggtgaatgattcaaaagtccaagatatagttgacctcattgaccatgcagagattgaatcagcaacacttttcacagacattgcaactcctcattcagtttgggtattcgcatgtgcaccagatcgctgcccaccgacagccttatatgttgcaggggttcctgagctaggggctttctttgccatccttcaggacatgcgaaatacaatcatggcatcaaagtctgtaggaacagctgaagaaaaactcaagaagaagtctgcattctaccagtcatacctaaggcggacacaatatatgggaatccaactggaccaaaagatcataatcctttacatgctatcctggggcaaggaagcagtgaaccatttccatcttggtgatgatatggatcctgagctcagacaacttgctcaatccttgattgataccaaggttaaggaaatttcaaaccaagagccattaaagctgtaa

SEQ ID NO: 2571 - RNA, 1287 nt, synthetic construct
  misc_feature 1..1287: note = derived and/or modified CDS sequence (wt) from ANDV(CHI-7913)__AY228237.1__N
  source 1..1287: mol_type = other RNA
atgagcaccctccaagaattacaagaaaacatcacagcacacgaacaacagctcgtgactgctcggcaaaagcttaaagatgccgagaaggcggtggaggtggacccggatgacgttaacaagagcacactacaaaatagacgggcagctgtgtctacattggagaccaaactcggggaactcaagagacaacttgcagatctggtggcagctcaaaaattggctacaaaaccagttgatccaacagggcttgagcctgatgaccatctgaaagagaaatcatctttgagatatgggaatgtcctggatgttaactcaatcgatttggaagaaccgagtggacagactgctgattggaaggctataggagcatatatcttagggtttgcaattccgatcatactaaaagccctatatatgctgtcaacccgtggaagacaggctgtgaaagacaacaaaggaaccaggataaggtttaaggatgattcttcctttgaagaggtcaatgggatacgtaaaccgaaacacctttatgtctcaatgccaactgcacaatctactatgaaggctgaggaaattacgccaggacggtttaggacaattgcttgtggcctctttccagcacaggtcaaagctcgaaatataataagtcctgtgatgggagtaatcggatttggcttctttgtgaaggactggatggatcggatagaggaattcctggctgcagagtgtccattcctgcctaagccaaaggttgcctcagaagccttcatgtctaccaacaagatgtattttctgaatagacaaagacaagtcaatgaatctaaggttcaagacatcattgatttaatagatcatgctgaaactgaatctgctaccttgtttacagaaattgcaacaccccattcagtctgggtgtttgcatgtgcgcctgaccggtgccctccgactgcattgtatgttgcaggggtaccagaacttggtgcattcttttccattcttcaggacatgcgcaataccatcatggcatccaaatctgtggggactgcagaagagaagctgaagaagaaatctgccttttatcaatcttacctaagaaggacacaatctatggggattcaactggaccagaaaatcataattctctacatgctttcatggggtaaagaagctgtgaatcatttccatcttggtgatgatatggaccctgaactaaggcagctagctcaatccctgattgacaccaaggtgaaggagatctccaaccaagagccacttaagttgtaa

SEQ ID NO: 2572 - RNA, 1287 nt, synthetic construct
  misc_feature 1..1287: note = derived and/or modified CDS sequence (wt) from ANDV(9718133)__AF482712.1__N
  source 1..1287: mol_type = other RNA
atgagcaccctccaagaattgcaggaaaacatcacagcacacgaacaacagctcgtgactgctcgacaaaagcttaaggatgccgagaaggcagtggaggtggacccggatgacgttaacaagagcacactacaaaatagacgggcagctgtgtctacattggagaccaaactcggagaacttaagaggcaacttgcagatttggtggcagctcaaaaattggctacaaaaccagttgatccaacagggcttgagcctgatgatcatctaaaggaaaaatcatctctgagatatgggaatgtcctggatgttaattcaattgatttggaagaaccgagtggacagactgctgattggaaggctataggagcatacatcttagggtttgcaattccgatcatcctaaaggccttatacatgctgtcaacccgtgggagacaaactgtgaaagacaacaaagggaccaggataaggtttaaggatgattcttcctttgaagaagtcaatgggatacgtaaaccaaaacatctttacgtctcaatgccaactgcacaatccactatgaaggctgaagaaatcacgccaggacgatttaggacgattgcttgtggcctttttccagcacaggtcaaagcccgaaatataataagtcctgtgatgggagtaattggatttggcttctttgtaaaggattggatggatcggatagaagaatttctggctgcagagtgtccattcttacctaagccaaaggtcgcctcagaagccttcatgtctaccaataagatgtattttctgaacagacagagacaagtcaatgaatctaaggttcaagatattatcgatttgatagaccatgctgagaccgagtctgctaccttgtttacagagattgcaacaccccactcagtctgggtgtttgcatgtgcacctgaccggtgccctccaactgcattgtatgttgcaggagtaccggaacttggtgcatttttttctatccttcaggacatgcgtaataccatcatggcatctaaatctgtagggactgcagaagagaagctaaagaaaaaatctgccttctaccaatcatacctaagaaggacacaatctatgggaatccaactggaccagaagatcataatcctttacatgctatcatggggtaaagaagctgtgaatcacttccatcttggtgatgatatggaccctgaactcaggcagctagcacaatctctgatcgatactaaggtgaaggagatctccaaccaagagccacttaagttgtag

SEQ ID NO: 2573 - RNA, 1278 nt, synthetic construct
  misc_feature 1..1278: note = derived and/or modified CDS sequence (wt) from Araraquara virus(9480)__KP202360.1__N
  source 1..1278: mol_type = other RNA
atgagcaacctccaagaattacaggaaaacatcaccgcacacgaacaacagctcgtgactgccaggcagaagcttaaagatgcagaaaaagcagttgatgtggacccagatgaggttaacaaaagcacattacaaggtagacgggcggctgtgtcaacattggagacaaaactcggggagcttaagaggcagttggcagatttggttgcggctcaaagactggcttcaaaaccagttgatccaacagggattgaacctgatgatcatttaaaggagaaatcatcacttagatatgggaatgtgctggatgttaattctattgatcttgaggagccaagtggacagacagcagactggaaggcaattggggcttacatcttgggatttgcaatccctattatactaaaggccttatatatgctgtcaactcgtggaaggcaaacagtgaaggacaacaaaggcactagaattaggttcaaggatgattcatcctttgaagaagtgaatgggatccggaaaccaaagcatctttacatctctatgccaactgcacagtccaccatgaaagctgaagagataacacctggaaggttcaggactattgcatgcggtttattcccagcacaagtaaaggcccggaacatcatcagtccagtcatgggggtaattggctttgcattttttgtgaaagattggatggagagaatagaagattttctagcctctgaatgcccatttttacccaaacctaagaatccctcagaggcattcatggccactaacaaggcttactttctcaatcgacagaagcaagttgatgaatctcaggtccctgatatagtagatttaattgaccatgctgaagctgagtcggcaactttatttaaggaaattgccagcccacattctgtttgggtattcgcatgtgcccctgatagatgcccaccgacagcattgtatgtagccggaatgcctgaattgggtgccttctttgcgatcttgcaggatatgaggaataccattatggcatctaaatcagttggcactgcagaagaaaagttgaagaagaaatctgctttttaccaatcttatttgagacggacacagtccatggggatacaactggaccaaaaaatcataatcttgtacatgctatcctggggtaaagaggctgtaaaccatttccacctgggtgatgatatggacccagaacttcgccaacttgctcagtcattgattgatactaaggttaaggaatctcaaaccaagagcctttaa

SEQ ID NO: 2574 - RNA, 1287 nt, synthetic construct
  misc_feature 1..1287: note = derived and/or modified CDS sequence (wt) from Araraquara-like virus(P5/Cajuru)__EF571895.1__N
  source 1..1287: mol_type = other RNA
atgagcaacctccaagaattacaggaaaacatcaccgcacacgaacaacagctcgtgactgccaggcagaagcttaaagatgcagaaaaagcagttgatgtggacccagatgaagttaacaagagcacattacaaggtagacgggcggctgtgtcaacattggagacaaaactcggggaacttaagagacagctggcagatttggttgcggctcaaagactggcttcaaaaccagttgatccaacagggattgagcctgatgaccatctaaaggaaaaatcgtcactgagatatgggaatgtgctggatgtcaaccctatcgatcttgaagagccaagtggccagacagcagactggaaggcaattggggcttacatcttgggttttgcaatccctattatactaaaggccttatatatgctgtcaacccgtggaaggcagacagtgaaagacaacaagggcactaggataaggttcaaggatgattcatcctttgaagaagtgaatggaattcggaaaccaaagcatctttatatctctatgccaacagcacaatccaccatgaaagctgaagagataacacctggaaggttcaggactattgcatgtgggttattccctgcacaagtgaaagcccggaatatcattagtccagtcatgggggtgattggttttggcttctttgtgaaagattggatggaaaggatagaagattttctagcctctgagtgcccttttttacctaaacccaagaatccttcagaggcatttatggcaactaacaaagcttacttcctcaacagacaaaagcaagttgatgagtctcaagttcccgatatagtagatttaattgaccatgctgaagctgagtcagcaaccttattcaaagagattgccagtccacattctgtatgggtatttgcatgtgctcctgacaggtgcccaccaactgcattatatgtagctgggttacctgaattgggtgccttctttgcgattttgcaggacatgaggaataccatcatggcatccaagtcagttgggactgcagaagaaaaattaaagaaaaaatctgccttctatcaatcttacttaagacggacacaatccatgggaatacaattggaccaaaaaatcataattttgtacatgctgtcctggggtaaagaggctgtgaaccatttccatctgggtgatgatatggatccagagcttcgtcagcttgctcagtcattgattgataccaaggttaaggagatttcaaaccaaggacccttaaagctgtga

SEQ ID NO: 2575 - RNA, 1287 nt, synthetic construct
  misc_feature 1..1287: note = derived and/or modified CDS sequence (wt) from BMJV(Oc22531)__AF482713.1__N
  source 1..1287: mol_type = other RNA
atgagcaccctccaagaattacaagaaaatatcacagcacacgaacaacagctcgtgactgctcggcaaaagctcaaagatgccgaaaagacggtggaggtggacccggatgaggttaacaagagcacactacaaagtagacgggcagctgtgtctacattggagaccaagctcggggaactcaagagacaacttgcagatttggtggcagctcaaaaactggctacaaaaccagttgatccaacagggcttgagcctgatgatcatctaaaggaaaagtcatccttaaggtatggcaatgtcctggatgtcaactccattgatctggaagaaccaagtggacagactgctgattggaggtctattggggcttatatactaggctttgcaatcccaatcatcctaaaggccttgtatatgctttctacccgcgggcgtcagactgtcaaagacaataaagggactagaatacggtttaaggatgattcatcatttgaagaggtcaatggcatccgaaagcccaagcacttgtatgtgtccatgccaacagcacagtcaacaatgaaggctgaggagataacaccagggaggttcagaacaattgcatgtggcctcttccctgcacaagttaaggcaagaaacatcattagtcctgtcatgggagttattggatttagcttctttgtaaaagattggatggaaaggatagaagactttttggcagctgaatgtcctttcctaccaaagccaaaggctccatctgaagcattcatggccactaacaaagcctattttttaaatagacaaaggcaagtgaatgagtcaaaagtccaggatatagttgacctcattgaccatgcggagactgagtcagcaacattgtttacggatattgctactccacactcagtgtgggtgtttgcatgtgcaccagatcgttgtccaccaacagccttatatgtcgccggtgttccagaattgggtgcattctttgccattttgcaggacatgcgaaacacaattatggcttcaaagtctgttgggacagctgaagaaaaactcaagaaaaaatctgccttctaccagtcatacttgagaaggacacaatctatggggattcaactggaccagaagatcataattctctacatgttatcatgggggaaagaagcagtgaaccactttcatcttggtgatgatatggatcctgagctcagacagctcgctcaatccttgattgatactaaggtgaaggagatttccaatcaagagccattaaagctgtga

SEQ ID NO: 2576 - RNA, 1287 nt, synthetic construct
  misc_feature 1..1287: note = derived and/or modified CDS sequence (wt) from LECV(22819)__AF482714.1__N
  source 1..1287: mol_type = other RNA
atgagcaccctccaagaattacaagaaaatatcacagcacacgaacaacagctcgtgactgctcggcaaaagcttaaagatgccgaaaagacggtggaggtggacccggatgaggttaacaagagcacactacaaagtagacgggcagctgtgtctacactggagaccaaactcggggaactcaagagacaacttgcagatctggtggcagctcaaaaactggctacaaaaccagttgatccaacagggcttgagcctgatgatcatctaaaggaaaagtcatccctgagatatggtaatgttctggatgtcaactctattgatctagaagaaccaagtggacagactgctgattggagatctattggggcatatatacttgggtttgcaataccaattatcctcaaggccctatatatgctttctacccgggggcggcagactgtcaaggacaacaaagggacaagaatccggtttaaagatgattcttcatttgaggaggtcaatggcatccgaaagcctaaacatttgtatgtatccatgcctacagcacaatcaacaatgaaggctgaagagataacaccaggcagatttagaacaattgcatgtggtctttttcctgcacaagtcaaagctagaaacatcattagtcctgtcatgggggtcattggattcagcttctttgtgaaggattggatggaaaggatagaagatttcctggcagctgaatgtcctttcttacccaaaccaaaggcaccatctgaagcattcatggccaccaataaagcctacttcttgaacagacaacgacaggttaatgagtcaaaagttcaggaaatagttgacctcattgatcacgcagagactgagtcagcaacattgtttacagatattgcaactccacactcagtatgggtgtttgcatgtgcaccagatcgttgcccaccaacagccttatatgttgccggtgttccagaactgggtgcattttttgctattctacaggatatgcggaatacaatcatggcatcaaagtctgtaggaacagctgaagagaagctgaagaaaaaatctgccttctaccagtcatacttgaggaggacacaatctatgggaattcagctggatcaaaagatcataatcctctatatgctatcatgggggaaggaggcagtaaatcactttcatcttggtgatgatatggatcctgagcttagacagcttgctcagtccttgattgacactaaggtgaaggagatttccaatcaggagccattaaagctgtaa

SEQ ID NO: 2577 - RNA, 1287 nt, synthetic construct
  misc_feature 1..1287: note = derived and/or modified CDS sequence (wt) from MCLV(13796)__AF482716.1__N
  source 1..1287: mol_type = other RNA
atgagcaacctccaagaattgcaagagaatatcactgcacacgaacaacaactcgtgactgccaggcagaagctgaaagatgcagaaaaagccgtggacgtggacccagatgaggttaacaagagtacactacaaggtcgacgggcagctgtgtcaacattggagaccaaacttggagagctcaagagacagcttgctgacttggtggcagctcaaaaactggctacaaaaccagttgatccaacagggattgagcctgatgaccatctgaaggaaaaatcatccttgagatatgggaatgtccttgatgtcaattctattgacctggaagaaccaagtggacaaaccgctgactggaaggctattggagcatacatactgggttttgcaattccgatcatcctaaaggctttgtacatgctgtcaacccgtggaaggcagacggtcaaggacaacaaggggactagaattagattcaaggatgattcatcttttgaagaagtaaatgggattaggaagccaaagcatctctacatctccatgccgactgctcagtccacaatgaaagctgaggagataacacctgggaggtttagaacgattgtatgtggattgtttcctgctcaagtgaaagcccggaatatcataagcccagtgatgggggtcattggttttagtttctttgtgaaggattggatggaacggatagagggattcttggcagcggaatgccctttcttacctaagcccaaaacagctgctgagacattcatggccaccaataaggcatacttttttaacaggcaacgccaggttgatgagtctcaagtcccagatattgttgaacttattgaccaggctgagtctgagtctgccaccctgtttacagaaatagctagcccccattcagtgtgggtgtttgcatgtgcacctgataggtgtccaccgacagcattatatgtggcaggagtgccagagctaggtgccttttttgccatactacaagatatgagaaataccattatggcatcaaagtctgtgggaacagctgaggagaagttaaagaagaaatcagcattctatcaatcttatttgagacgaacacagtcaatggggattcaactggaccagaagatcatcatcctgtatatgttgtcttggggtaaggaggctgtgaaccatttccatcttggtgatgatatggatcctgaattgagacaactagcacaggctttaattgatactaaagtgaaggagatctcaaaccaggagcctttgaagctgtaa

SEQ ID NO: 2578 - RNA, 1287 nt, synthetic construct
  misc_feature 1..1287: note = derived and/or modified CDS sequence (wt) from Neembucu(Neembucu)__DQ345763.1__N
  source 1..1287: mol_type = other RNA
atgagcaccctccaagaattacaagaaaacatcacagcacacgaacagcagctcgtgactgctcggcaaaagcttaaagatgccgaaaagacggtggaggtggacccggatgaggttaacaagagcacactacaaagtagacgggcagctgtgtctacattggagaccaaactcggggaactcaagagacaacttgcagatctggtggcagctcaaaaactggctacaagaccagttgatccaacagggcttgagcctgatgatcatctaaaggaaaagtcatccttaaggtatggcaacgtcctggatgtcaactccattgatctggaagaaccaagtgggcagactgccgactggaggtctattggagcttatatactaggctttgcaatcccaattatcctaaaagccttatatatgctttctaccagagggcggcagactgtcaaggacaacaaagggaccaggatacggttcaaggatgattcatcttttgaagaggtcaatggcatccgaaagcccaagcatttgtatgtatccatgccaacagcacaatcaacaatgaaggctgaggagataacaccaggtagacttagaacaattgcatgtggtctattccctgcacaagtcaaggcaaggagcattatcagtcctgtcatgggagtcatcggatttagcttctttgtaaaggactggatggaaaggattgaagacttcttggcagctgaatgccctttcctgccgaagccaaaggctccatctgaagcattcatggccactaacaaggcctattttttaaataggcaacggcaagtaaatgagtcaaaagtccaagatatagttgatctcattgaccatgcagagaccgagtcagcaacactgttcacagatattgctactccacactcagtgtgggtatttgcatgtgcaccagatcgctgtccaccaacagctttatatgttgctggtgttccagaattgggtgcattttttgccatcttacaggacatgcgaaacacaatcatggcctcaaaatctgtagggacagctgaagaaaagctcaagaagaagtctgctttctaccagtcatacttaagaaggacacagtccatggggattcaactggaccaaaagatcatcatcctctacatgttgtcttggggaaaagaagcagtgaaccacttccatcttggggatgatatggatcctgagcttagacagcttgctcagtctttgattgatactaaggtgaaagagatttccaatcaagagccactaaagctgtaa

SEQ ID NO: 2579 - RNA, 1287 nt, synthetic construct
  misc_feature 1..1287: note = derived and/or modified CDS sequence (wt) from ORNV(22996)__AF482715.1__N
  source 1..1287: mol_type = other RNA
atgagcaccctccaagaactacaggaaaatatcacagcacacgaacaacagctcgtgactgctcggcaaaagcttaaagatgccgaaaagacggtggaggtggacccggatgaggttaacaagagcacattacaaagtagacgggcagctgtgtctacattggagaccaaactcggagaacttaagaggcagcttgcggatctggtggcagctcaaaaactggctacaaaaccagttgatccaacagggcttgagcctgatgatcatctgaaagaaaaatcatctctccgttatgggaatgtcctggatgtcaactccattgatcttgaagagccaagtggtcaaactgctgattggaaagctattggggcctacatattaggatttgccataccaatcatcctgaaagctctctacatgctttccacccgtgggagacaaactgtcaaagacaacaaggggactagaataaggttcaaggatgactcatcatttgaagaggtcaacggtatccggaaaccgaagcatctctatgtgtcaatgccaactgcacaatcaacaatgaaggctgaagagataacacctggacggttcaggacaattgcatgtggactcttccctgcacaagtgaaagccaggaacatcatcagtccagtcatgggagtaatcgggtttagcttctttgtgaaggattggatggaaaggattgaggatttcctggcagctgaatgcccattcttacctaaacccaaggcattgtctgaagcattcatggctactaataaagcttatttcctgaataggcaacggcaggtgaatgattcaaaagtccaagatatagttgacctcattgaccatgcagagattgaatcagcaacacttttcacagacattgcaactccccattcagtttgggtattcgcatgtgcaccagatcgctgcccaccgacagccttatatgttgcaggggttcctgagctaggggctttctttgccatccttcaggacatgcgaaatacaatcatggcatcaaagtctgtaggaacagctgaagaaaaactcaagaagaagtctgcattctaccagtcatacctaaggcggacacaatctatgggaatccaactggaccaaaagatcataatcctttacatgctatcctggggcaaggaagcagtgaaccatttccatcttggtgatgacatggatcctgagctcagacaacttgctcaatccttgattgataccaaggttaaggaaatttcaaaccaagagccattaaagctgtaa

SEQ ID NO: 2580 - RNA, 1287 nt, synthetic construct
  misc_feature 1..1287: note = derived and/or modified CDS sequence (wt) from PRGV(14403)__AF482717.1__N
  source 1..1287: mol_type = other RNA
atgagcaccctccaagaattgcaggaaaatatcaccgcacacgaacaacatctcgtcactgccaggcagaaacttaaagatgccgagaagaccgtggaagtggacccagatgaagtcaacaagagcacattacaaagtagacgggcggctgtgtctacattggagaccaaacttggagagctcaagaggcagcttgcagatttggtggcagctcaaaagctggctgcaaagccagttgatccaacagggcttgagcctgatgaccatctgaaggagaaatcatctttgaggtatgggaatgtcttggatgtcaactccattgaccttgaagaaccgagtggtcaaacagctgattggaaagcaattggggcttatatactgggatttgcaattccaatcatactgaaagcactatacatgttatccacccgtggaaggcaaacagttaaggacaacaaaggcaccagaataaggttcaaagatgattcatcctttgaagaggtaaatgggatccggaagccgaaacatctttatgtttcaatgccaacagcacagtccacaatgaaagctgaagaaataacaccaggcaggtttagaactattgcttgtgggcttttccctgcacaagttaaggccaggaatataattagtccagtcatgggggtaattggtttcagcttcttcgtcaaggactggatggaaagaattgaagatttcttagctgcagagtgtccgtttctacctaagcctaaaaccacctctgaggcattcatgtcaactaataaggcttatttcttaaacaggcagagacaggttgatgaatctcaagtcccagacatagcagaactgatagaacaggcggaatctgagtcagcaactttattcacagaaattgcaagccctcattcagtatgggtatttgcatgtgcaccagatagatgcccgcctacagccctgtatgttgcaggagtaccagaacttggggccttttttgctatactacaagacatgaggaacacaataatggcatcaaagtcggtcgggactgcagaagagaagctcaagaagaagtctgctttctaccagtcatacttgcggagaacccagtcaatggggattcagttggatcagaagattataatcctctatatgttgtcatggggaaaggaggctgtcaatcattttcatcttggtgatgatatggatcctgagctcagacaactggctcaagctttgattgacacaaaagtaaaggagatttctaaccaagagccattgaaattgtaa

SEQ ID NO: 2581 - RNA, 1287 nt, synthetic construct
  misc_feature 1..1287: note = derived and/or modified CDS sequence (wt) from TUNV(FVB554)__JF750419.1__N
  source 1..1287: mol_type = other RNA
atgagcaacctccaagaactacaagaaaatatcacagcacacgaacagcagctcgtgactgctcggcaaaagcttaaagatgccgagaaagcagtggagatggacccggatgacgttaacaagagcacattacaaagtaggagggcagctgtgtctacactggagaccaaactcggagaactcaagagacaacttgcggatatggtggcagctcaaaaactggctacaaaaccagttgatccaacagggcttgagcctgatgaccatctgaaggaaaagtcttctctgagatatgggaatgtcctggatgttaattccatcgacctggaggaaccgagtggccagactgcagactggaaatcaattggggcctacatcttaggttttgcaatcccaataattttgaaggcattgtacatgctttctacccgagggagacaaacagtcaaggacaataaagggaccaggataaggttcaaggatgattcgtcttttgaggaagtaaatgggattcgaaagccaaaacatctgtatgtatcaatgccaactgcccagtccaccatgaaagctgaagagataacaccaggaaggttcagaacaattgcatgtggtctattcccagcacaggtgaaagcacgaaacattatcagtcccgtcatgggggtcattgggttcagtttctttgtaaaagactggatggagcggattgaagatttcctagctgatgagtgccctttcttgccaaagcctaaatcaccatctgaagcattcatggcaactaataaggcatatttccttaatagacaaagacaagtaaatgattcaaaggttcaggacatagtagacctgatagaccatgctgaaacagagtcagctaccctgtttacagatattgctacaccccattcagtctgggtttttgcatgtgcaccagacaggtgtccaccaacagcattgtatgtagctggtgtccctgagttgggggctttttttgcaatcctccaagatatgagaaacaccatcatggcatcaaaatctgtgggaacagcagaggagaaattgaagaagaagtctgctttttatcaatcatatcttaggaggacacaatctatggggatccagcttgatcaaaaaatcatcattctttatatgttgtcctgggggaaggaagctgtaaaccacttccatctcggagatgatatggatcctgagctaaggcagcttgctcaggcattgattgatactaaggtgaaagagatttccaaccaagagccattaaaattgtag

SEQ ID NO: 2582 - RNA, 1287 nt, synthetic construct
  misc_feature 1..1287: note = derived and/or modified CDS sequence (wt) from BCCV(BCCV)__AB689163.1__N
  source 1..1287: mol_type = other RNA
atgagcaacctcaaagaagttcaggacaatattacaacccacgaacagcagctagtggcagctagacaaaagctgaaagatgcagaaaggacggttggggtggacccggatgacgttaacaagagcacactacagaacagacgggcagctgtgtctgcattggaggccaaaattggggagctcaagagacaacttgcagatcttgttgcagctcagaaattggctacaaaatctgttgatccaacagggattgaacctgatgatcatctgaaagaaaagtcctcccttaggtatggcaatgtgcttgacgtcaattcaattgaccttgaggaaccaagtgggcagactgctgactggaaagcaatcgggacttatattcttagttttgtccttccaattgtgttgaaggccctctatatgttgtcaacacgaggaaggcagacagttaaggaaaataaagggacaagaatcagattcaaggatgattcttcttatgaagatgttaatggtattcggaagcccaaacacttgtatgtgtccttgcctacagcacagtcaacaatgaaggcagatgagatcacaccaggtcgattccgtactattgtatgtgggttattccctgcacagattaaagcacggaatattataagccctgtcatgggagtgattgggttttcattctttgtgaaggattgggttgataaaattgaggactttttaagggctgaatgtccattcctaccaaaaccaagggcacaagcagagtcattcctgtcgacaaatggtgcttactttatgaatagacagacacaggttgaagagtcaaaggtgcaggacattttagacctaattgacactgctgaatcagggggtgcaacattatttgataatattgctagccctcaatctgcatggatatttgcctgtgcaccggaccgatgtccaccgacagcattgtatgttgctggtgtgcctgaattaggagcattcttttcaatactccaagatatgaggaatacaattatggcatctaagtctgtaggaactgctgaagaaaaactgaaaaagaaatctgccttctaccagtcttacttacgcagaacacagtcaatggggattcaactggaccagaaaatcattatattgtatatgattaactggggaaaagaggctgtcaaccactttcatctcggggatgacatggatcctgaattgcggcagctagcacaagccttagtagacactaaggttaaagagatttcaaatcaagagcctttaaagatatga

SEQ ID NO: 2583 - RNA, 1287 nt, synthetic construct
  misc_feature 1..1287: note = derived and/or modified CDS sequence (wt) from BCCV(BCCV)__L39949.1__N
  source 1..1287: mol_type = other RNA
atgagcaacctcaaagaagttcaggacaatattacaacccacgaacagcagctagtggcagctagacaaaagctgaaagatgcagaaaggacggttgaggtggacccggatgacgttaacaagagcacactacagaacagacgggcagctgtgtctgcattggaggccaaaattggggagctcaagagacaacttgcagatcttgttgcagctcagaaattggctacaaaatctgttgatccaacagggattgaacctgatgaccatctgaaagaaaagtcctcacttaggtatggcaatgtgcttgacgtcaattcaattgaccttgaggaaccaagtgggcagactgctgactggaaagcaatcgggacttatattcttagttttgtccttccaattgtgttgaaggccctctatatgttgtcaacacgaggaaggcagacagttaaggaaaataaagggacaagaatcagattcaaggatgattcttcttatgaagatgttaatggtattcggaagcccaaacacttgtatgtgtccttgcctacagcacagtcaacaatgaaggcagatgagatcacaccaggtcgattccgtactattgtatgtgggttattccctgcacagattaaagcacggaatattataagccctgtcatgggagtgattgggttttcattctttgtgaaggattgggttgataaaattgaggactttttaagggctgaatgtccattcctaccaaaaccaagggcacaagcagagtcattcctgtcgacaaatggtgcttactttatgaatagacagacacaggttgaagagtcaaaggtgcaggacattttagacctaattgacactgctgaatcagggggtgcaacattatttgataatattgctagccctcaatctgcatggatatttgcctgtgcaccggaccgatgtccaccgacagcattgtatgttgctggtgtgcctgaattaggagcattcttttcaatactccaagatatgaggaatacaattatggcatctaagtctgtaggaactgctgaagaaaaactgaaaaagaaatctgccttctaccagtcttacttacgcagaacacagtcaatggggattcaactggaccagaaaatcattatattgtatatgattaactggggaaaagaggctgtcaaccactttcatctcggggatgacatggatcctgaattgcggcagctagcacaagccttagtagacactaaggttaaagagatttcaaatcaagagcctttaaagatatga

SEQ ID NO: 2584 - RNA, 1290 nt, synthetic construct
  misc_feature 1..1290: note = derived and/or modified CDS sequence (wt) from DOBV(DOBV/Ano-Poroia/Afl9/1999)__NC_005233.1__N
  source 1..1290: mol_type = other RNA
atggcaacattagaggaactccaaaaagaaatcaacaaccacgagggccaattggtgatagccaggcagaaggtgaaagatgcagaaaagcagtatgaaaaggatcctgacgacctgaataaaagggcattgagtgaccgggaaagcattgcacaatcaattcagggaaaaatagatgaattaaggagacagctggctgatcgtgtggcagcagggaaaaacattggcaaagagagggacccaactggactagaccctggagatcacctcaaagagaagtcaatgctcagttatggaaatgtcattgacctcaaccatcttgacattgatgaacctacagggcaaaccgcagactggctgagcattgtggtctacctgacatcattcgtggttccaatattgttgaaggctctttacatgcttaccaccagagggagacaaactactaaagacaataagggaatgagaattcgatttaaggatgacagctcttttgaagatgtgaatgggattagaaagccaaagcacctgttcttgtcaatgcccaatgcacaatctagcatgaaggcagatgagattacaccaggtcggttcaggactgcaatttgtggactatacccagcccaggtgaaggcaaggaacttaatcagtcctgtgatgagtgtgattgggtttttagcccttgcaaagaactggacagagcgggttgaggaatggcttgacctcccgtgcaagctactatctgagccatctccaacgtctttgaccaaaggcccatccaccaatcgtgactacttgaatcaaagacaaggagcgcttgcaaaaatggaaacaaaagaagctcaggctgtgaggaaacatgccatagatgctggctgcaaccttatcgaccatatagactcaccatcatcaatctgggtctttgcaggagcacccgacagatgccctcctacctgcctgttcattgcaggcatggcagagctaggtgcattctttgctgttctccaggatatgaggaacaccatcatggcgtcaaaaactatcggaacatctgaggagaagctaaagaagaaatcatctttttaccaatcttacctacggaggacacaatctatggggatacaactggaccagcgcatcatcgtgctcttcatggttgactggggaaaagaggcagttgatagttttcatcttggtgatgatatggatcctgagctccggggcctggcacaggcattaattgatcaaaaagtgaaggaaatatctaatcaggaaccgcttaagctttaa

SEQ ID NO: 2585 - RNA, 1290 nt, synthetic construct
  misc_feature 1..1290: note = derived and/or modified CDS sequence (wt) from DOBV(DOB/Saaremaa/160V)__AJ009773.1__N
  source 1..1290: mol_type = other RNA
atggcaacactagaggaactccaaaaggagatcaatagccacgagggccaattggtgatagccaggcagaaggtgaaagatgcagagaaacaatatgaaaaagatcctgatgaccttaataaaagggcattgagtgatagagaaagcattgcacaatcaatccagggcaaaattgatgagctaaggagacagctggctgaccgtgtggctgcaggaaaaaacattggcaaggagagggacccaactggactagatcctggtgatcaccttaaagagaaatcaatgcttagttatggaaatgtcattgacctcaatcatcttgacattgatgaaccaacagggcaaactgctgactggctaagcattgtgatctatttgacatctttcgtagtcccaatactcctgaaggctctttacatgttgacaactagagggaggcaaactactaaagacaataagggaatgaggattcgatttaaggatgacagttcttttgaggatgtgaatggaattcgaaaaccaaaacatctgttcttgtcgatgcccaatgcccagtccagcatgaaagcagatgagattacacctggtaggttcagaactgcagtctgtggattatacccagcccaggttaaagcaaggaatttgatcagccccgtcatgagtgtgattggtttcttaacccttgcaaagaattggacggaacgggttgaggagtggcttgacctcccttgcaagctattatctgaaccatctccaacatctttaaccaaagggccttccactaaccgtgattatctgagtcaaagacaaggagcacttgcgaagatggaaacaaaagaagcccaggttgttagaaaacatgccatagatgctggttgtaacatcattgaccatattgactcaccgtcatcaatttgggtttttgctggggcacctgataggtgtccccctacctgcctgttcattgcaggcatggcagaattaggtgcattctttgctgtcctccaggatatgaggaatacgatcatggcatcaaaaactattggaacatcagaggagaagttgaggaagaagtcttcgttctaccaatcttacctccggaggacacagtctatgggtattcaactggaccagcgcatcattgtgcttttcatgatagaatggggtaaagaggcagttgatagtttccacctaggtgatgatatggatccagaaattcgaagtctagcacaggcattgatcgatcaaaaggtaaaagaaatatctaatcaggagccgctcaagctttaa

SEQ ID NO: 2586 - RNA, 1290 nt, synthetic construct
  misc_feature 1..1290: note = derived and/or modified CDS sequence (wt) from DOBV(Slovakia/400Af/98)__AY168576.1__N
  source 1..1290: mol_type = other RNA
atggcaacattagaggaactccaaaaagaaatcaacaaccacgagggccaattggtgatagccaggcagaaggtgaaagatgcagaaaagcagtatgagaaagaccctgatgatctgaacaaaagggcattgagtgaccgggaaagcattgcacaatcaatccagggaaaaatcgatgaactaaggagacagctggctgatcgtgtagcagcagggaaaaacatcggcaaagagagggacccaactgggctggaccctggagatcacctcaaagagaagtcaatgctcagttatggaaatgtcattgacctcaaccatcttgatattgatgagcctacagggcaaaccgcagactggctgagcattgtggtatacttgacatcattcgtggttccaatactgttgaaggctctttacatgcttaccaccagagggagacaaactactaaagacaataagggaatgaggattcgatttaaggatgacagctcttttgaagatgtgaatgggattcgaaagccaaagcacctgttcttgtcaatgcccaatgcacaatctagtatgaaggcagatgagattacaccgggtcggttcaggactgcaatttgtggactatacccagcccaggtcaaagcaaggaacttaatcagtcctgtgatgagtgtgattgggtttttagcccttgcaaaaaattggacagagcgggttgaggaatggcttgacctcccgtgcaagctactatctgagccatctccaacgtctttgaccaaaggcccatccaccaatcgtgactacttgaatcaaagacaaggagcgcttgcgaaaatggaaacaaaggaagctcaggctgtaaggaaacatgccatagatgctggctgtaaccttattgaccatatagactcaccatcatcaatttgggtcttcgcaggagcacccgacagatgccctcctacctgccttttcattgcaggcatggcagagctaggtgcattctttgctgtcctccaggatatgaggaacaccatcatggcatcaaaaaccattggaacatctgaggagaagctaaagaagaagtcatctttttatcaatctttactacggaggacacaatctatggggatacaactggaccagcgcatcatcgttctcttcatggttgactggggaaaagaggcagttgatagttttcaccttggtgatgatatggatcctgagctccggggcctggcacaggcattaattgaccaaaaagtgaaggaaatatctaatcaggagccgcttaagctttaa

SEQ ID NO: 2587 - RNA, 1290 nt, synthetic construct
  misc_feature 1..1290: note = derived and/or modified CDS sequence (wt) from DOBV(Slovakia-856-Aa)__AJ269549.1__N
  source 1..1290: mol_type = other RNA
atggcaacactagaggaactccaaaaagagatcaatagccacgaaggccaactggtgatagccaggcagaaggtgaaggatgcagaaaagcagtatgaaaaggaccctgatgacctcaacaaaagggcattgagtgaccgggaaagcgttgcacaatcaatccaaagcaaaatcgatgagctaaggagacagctagctgaccgtgtagctgcagggaaaaacattggtaaggaaagggatccaactggactagaccctggcgaccatcttaaagaaaaatcaatgctcagttacgggaatgtcatcgaccttaaccaccttgacattgatgaaccaactgggcaaactgctgattggctgagcattgtggtctatctaacatcttttgtggtcccaatactcttaaaagctctttacatgttgacaactagagggagacagactactaaggacaacaagggaatgaggattcgttttaaggatgatagctcgtttgaagatgtgaatgggattcgaaagccaaaacatctattcttgtcaatgcctaatgctcagtccagtatgaaagcagatgaaattacacctggccgattcagaactgcaatttgtggattatatccagctcaggttaaagcaaggaatttggttagccctgtcatgagtgtgatcggtttcatggcccttgcaaagaactggacagaaagagttgaagagtggttagatcttccatgtaagctgctatctgaaccatctccaacatccttgaccaaaggcccatccaccaaccgggattacttaaaccaacggcaaggtgcacttgcaaaaatggagacaaaagaagcacaggctgtgaggaagcatgccatagatgctggttgtaacatcattgaccatattgactcaccatcatcaatttgggtttttgccccggcacctgataggtgcccccctacctgcctgtttattgcaggcatggcagagttaggtgcatttttttctgtcctccaggacatgaggaatacaatcatggcatcaaaaaccatcgggacttctgaagaaaagttgaggaaaaaatcctcattttaccaatcttaccttcgaagaacacagtctatgggaatccagcttgatcagcgcattattgtgctttttatggtggattggggcaaagaagcagttgacagtttccacctaggtgatgatatggacccggagcttcggggtctggcacaggccttgattgaccagaaagtgaaagaaatatctaatcaagagccgcttaaactttaa

SEQ ID NO: 2588 - RNA, 1290 nt, synthetic construct
  misc_feature 1..1290: note = derived and/or modified CDS sequence (wt) from DOBV(Slovakia-862-Aa)__AJ269550.1__N
  source 1..1290: mol_type = other RNA
atggcaacactagaggaactccaaaaagagatcaatagccacgaagggcaactggtgatagccaggcagaaggtgaaggatgcagaaaagcagtatgaaaaggaccctgatgacctcaacaaaagggcattgagtgaccgggaaagcgttgcacaatcaatccaaagcaaaatcgatgagctaaggagacagctagctgaccgtgtagctgcagggaaaaacattggtaaggaaagggatccaactggactagaccctggcgaccatcttaaagaaaaatcaatgctcagttacgggaatgtcatcgaccttaaccaccttgacattgatgaaccaactgggcaaactgctgattggctgagcattgtggtctatctaacatcttttgtggtcccaatactcttaaaagctctttacatgttgacaactagagggagacagactactaaggacaacaagggaatgaggattcgttttaaggatgatagctcgtttgaagatgtgaatgggattcgaaagccaaaacatctattcttgtcaatgcctaatgctcagtccagtatgaaagcagatgaaattacacctggccgattcagaactgcaatttgtggattatatccagctcaggttaaagcaaggaatttggttagccctgtcatgagtgtgatcggtttcatggcccttgcaaagaactggacagaaagagttgaagagtggttagatcttccatgtaagctgctatctgaaccatctccaacatccttgaccaaaggcccatccaccaaccgggattacttaaaccaacggcaaggtgcacttgcaaaaatggagacaaaagaagcacaggctgtgaggaagcatgccatagatgctggttgtaacatcattgaccatattgactcaccatcatcaatttgggtttttgccgggcgacctgataggtgcccccctacctgcctgtttattgcaggcatggcagagttaggtgcatttttttctgtcctccaggacatgaggaatacaatcatggcatcaaaaaccatcgggacttctgaagaaaagttgaggaaaaaatcctcattttaccaatcttaccttcgaagaacacagtctatgggaatccagcttgatcagcgcattattgtgctttttatggtggattggggcaaagaagcagttgacagtttccacctaggtgatgatatggacccggagcttcggggtctggcacaggccttgattgaccagaaagtgaaagaaatatctaatcaagagccgcttaaactttaa

SEQ ID NO: 2589 - RNA, 1290 nt, synthetic construct
  misc_feature 1..1290: note = derived and/or modified CDS sequence (wt) from DOBV(Esl/29Aa/01)__AY533118.2__N
  source 1..1290: mol_type = other RNA
atggcaacactagaagaactccaaaaggagatcaatagccatgaaggccaactggtgatagccaggcagaaggtgaaggatgcagaaaagcagtatgaaaaggaccctgatgaccttaacaaaagggcattgagtgaccgggaaagtgtcgcacagtcaatccagagcaagattgatgaattaaggagacagctggctgaccgtgtggctgcaggaaaaaacattggtaaagaaagggatccaaccggactagaccctggtgatcatcttaaagaaaaatcaatgctcagttatgggaatgttattgatctcaaccaccttgacattgatgaaccaactgggcagactgctgattggctaagtattgtggtctatttaacatcttttgtggtcccgatactcttaaaggctctttatatgttaacaactagagggagacagactactaaggacaacaagggaatgaggattcgcttcaaggatgacagctcgtttgaggatgtgaacgggatccggaaaccaaaacatttattcctgtcaatgcccaatgctcagtccagtatgaaggcagatgaaattacacctggccgattcagaactgcaatttgtggattatatccagctcaggttaaagcaagaaatttggttagtcctgtcatgagtgtgattggttttttggcccttgcaaagaactggacagagagggttgaagagtggttggatcttccatgtaagctgctatctgagccatctccaacatctttgaccaaaggcccatccaccaaccgtgattacttaaaccaacggcaaggagcacttgcaaaaatggagacaaaagaagctcaggcagtgaggaagcatgccatagatgctggttgtaacatcattgatcacatcgactcaccatcatcaatttgggtttttgctggggcacctgataggtgcccccctacctgcctgtttattgcaggcatggcagagttaggtgcattcttttctgtcctccaggacatgaggaatacaatcatggcatcaaaaaccatcgggacttctgaggagaagttgagaaaaaaatcatcattctaccagtcttaccttcgaaggacacaatcaatgggaatccagctggaccaacgcattattgtgctttttatggtggactggggcaaagaagcagttgacagtttccatctaggcgatgatatggacccagagcttcggggtctggcacaggcattgattgaccagaaagtgaaggagatatccaatcaagagccgctcaaactttaa

SEQ ID NO: 2590 - RNA, 1290 nt, synthetic construct
  misc_feature 1..1290: note = derived and/or modified CDS sequence (wt) from DOBV(Kurkino/44Aa/98)__AJ131672.1__N
  source 1..1290: mol_type = other RNA
atggcaacactagaggaactccaaaaagaaataaatagccatgagggccaactagtgatagccagacagaaggtaaaggatgcagaaaagcagcatgagaaagaccctgatgaccttaacaaaagggcactgagtgaccgggaaagcgttgcacagtcaatccagagtaaaatcgatgaactaaggagacagctggctgaccgtgtggctgcagggaaaaacattggcaaagagagggatccaactggactagaccctggtgaccaccttaaagagaagtcaatgctcagttatgggaatgtcattgatctcaaccaccttgacattgatgaaccgactgggcaaactgctgattggctgagcattgtggtctatttgacatcttttgtggttccgatactcttaaaggctctttacatgttgacaaccagaggaaggcaaactactaaggacaataagggaatgaggattcgctttaaggatgacagctcattcgaggatgtaaatggaatccggaagccaaaacacctgttcttgtcaatgcctaatgctcaatccagcatgaaagcagatgagattacacctggccgattcaggactgcaatttgtggattatacccagctcaggtcaaagcaagaaatttggtcagtcctgtcatgagtgtgattggctttttagcccttgcaaagaactggacagaaagagttgaagagtggcttgaccttccatgcaagctactatctgagccatctccaacatctctgaccaaaggcccgtccaccaaccgtgattacttgaaccaacgacaagcagcacttgcaaaaatggagacaaaggaagctcaggctgtgagaaaacatgccatagatgctggttgtactatcattgattacattgactcaccatcatcaatctgggtctttgctggggcacctgataggtgcccccccacctgcctgtttattgcaggcatggcagagttgggtgcatttttttctgtcctccaggacatgaggaatacgattatggcatcaaaaactgtcggaacttcagaggagaagctgaggaagaagtcatcattttatcaatcttacctccgaagaacacaatctatgggaatccagctggaccagcgcattattgtgcttttcatggtggactggggcaaagaagcagttgatagtttccatctaggtgatgatatggacccagagcttcgaggcctggcacaggcattgattgaccagaaagtgaaggagatatctaaccgagagccgcttaagctttaa

SEQ ID NO: 2591 - RNA, 1290 nt, synthetic construct
  misc_feature 1..1290: note = derived and/or modified CDS sequence (wt) from DOBV(Kurkino/53Aa/98)__AJ131673.1__N
  source 1..1290: mol_type = other RNA
atggcaacactagaggaactccaaaaagaaataaatagccatgagggccaactagtgatagccagacagaaggtaaaggatgcagaaaagcagtatgagaaagaccctgatgaccttaacaaaagggcattgagtgaccgggaaagcgttgcacagtcaatccagagtaaaatcgatgaactaaggagacagctggctgaccgtgtggctgcagggaaaaacattggcaaagagagggatccaactggactagaccctggtgaccaccttaaagagaagtcaatgctcagttatgggaatgtcattgatctcaaccaccttgacattgatgaaccgactgggcaaactgctgattggctgagcattgtggtctatttgacatcttttgtggttccgatactcttaaaggctctttacatgttgacaaccagaggaaggcaaactactaaggacaataagggaatgaggattcgctttaaggatgacagctcattcgaggatgtaaatggaatccggaagccaaaacacctgttcttgtcaatgcctaatgctcaatccagcatgaaagcagatgagattacacctggccgattcaggactgcaatttgtggattatacccagctcaggtcaaagcaagaaatttggtcagtcctgtcatgagtgtgattggctttttagcccttgcaaagaactggacagaaagagttgaagagtggcttgaccttccatgcaagctactatctgagccatctccaacatctctgaccaaaggcccgtccaccaaccgtgattacttgaaccaacgacaagcagcacttgcaaaaatggagacaaaggaagctcaggctgtgagaaaacatgccatagatgctggttgtactatcattgatcacattgactcaccatcatcaatctgggtctttgctggggcacctgataggtgcccccccacctgcctgtttattgcaggcatggcagagttgggtgcatttttttctgtcctccaggacatgaggaatacgattatggcatcaaaaactgtcggaacttcagaggagaagctgaggaagaagtcatcattttatcaatcttacctccgaagaacacaatctatgggaatccagctggaccagcgcattattgtgcttttcatggtggactggggcaaagaagcagttgatagtttccatctaggtgatgatatggacccagagcttcgaggcctggcacaggcattgattgaccagaaagtgaaggagatatctaaccgagagccgcttaagctttaa

SEQ ID NO: 2592 - RNA, 1290 nt, synthetic construct
  misc_feature 1..1290: note = derived and/or modified CDS sequence (wt) from DOBV(Saar/90Aa/97)__AJ009775.1__N
  source 1..1290: mol_type = other RNA
atggcaacactagaggaactccaaaaagagatcaatagccacgagggccaactggtgatagccaggcagaaggtgaaagatgcagagaaacaatacgaaaaagatcctgatgaccttaataaaagggcattgagtgatagagaaagcattgcacaatcaatccagggcaaaattgatgagctaaggagacagctggctgatcgtgtggctgcaggaaaaaacattggcagggagagggacccaactggactagatcctggtgatcaccttaaagagaaatcaatgcttagttatggaaatgtcattgacctcaatcatcttgacattgatgaaccaacagggcaaactgctgactggctaagcattgtgatctatctgacatctttcgtagtcccaatactcctgaaggctctttacatgttgacaactagagggaggcagactactaaagacaataagggaatgaggattcgatttaaggatgatagttcttttgaggatgtgaatggaattcgaaaaccaaaacatctgttcttgtcaatgcccaatgcccaatccagtatgaaagcagatgagattacacctggcaggttcagaactgcagtctgtggattatacccagcccaggttaaagcaaggaatttgatcagccccgtcatgagtgtgattggtttcttaacccttgcaaagaattggacggaacgggttgaggagtggcttgacctcccttgcaagctattatctgaaccatctccaacatctttaaccaaggggccttccactaaccgtgattatctgagtcaaagacagggagcacttgcgaagatggaaacaaaagaagcccaggctgtgagaaaacatgccatagatgctggttgtaacatcattgaccatattgactcaccgtcatcaatctgggtttttgctggggcacctgataggtgtccccctacctgcctgttcattgcaggcatggcagagttaggtgcattctttgctgtcctccaggatatgaggaatacaatcatggcatcaaaaactattggaacatcagaggagaagttgaggaagaagtcttcattctaccaatcttacctccggaggacacagtctatgggtattcaactggaccagcgcatcattgtgctttttatgatagaatggggtaaagaggcagttgatagtttccacctaggtgatgatatggatccagaaattcgaagtctagcacaggcattgatcgatcaaaaggtaaaggaaatatctaatcaggagccgctcaagctttaa

SEQ ID NO: 2593 - RNA, 1290 nt, synthetic construct
  misc_feature 1..1290: note = derived and/or modified CDS sequence (wt) from DOBV(SK/Aa)__AY961615.1__N
  source 1..1290: mol_type = other RNA
atggcaacactagaagaactccaaaaggagatcaatagccatgaaggccaactggtgatagccaggcagaaggtgaaggatgcagaaaagcagtatgaaaaggaccctgatgaccttaacaaaaggacattgagtgaccgggaaagtgtcgcacagtcaatccagagcaagattgatgaattaaggagacagctggctgaccgtgtggctgcaggaaaaaacattggtaaagaaagggatccaactggactagaccctggcgatcatcttaaagaaaaatcaatgctcagttatgggaatgttatcgatctcaaccaccttgacattgatgaaccaactgggcagactgctgattggctaagtattgtggtctatttaacatcttttgtggtcccgatactcttaaaggctctttatatgttaacaactagagggagacagactactaaggacaacaagggaatgaggattcgcttcaaggatgacagctcgtttgaggatgtgaacgggatccggaaaccaaaacatttattcctgtcaatgcctaatgctcagtccagtatgaaggcagatgaaattacacctggccgattcagaactgcaatttgtggattatatccagctcaggttaaagcaagaaatttggttagtcctgtcatgagtgtgattggttttttggcccttgcaaagaactggacagagagggttgaagagtggttagatcttccatgtaagctgctatctgagccatctccaacatctttgaccaaaggcccatccaccaaccgtgattacttaaaccaacggcaaggagcacttgcaaaaatggagacaaaagaagctcaggcagtgaggaagcatgccatagatgctggttgtaacatcattgatcacatcgactcaccatcatcaatttgggtttttgctggggcacctgataggtgcccccctacctgcctgtttattgcaggcatggcagagttaggtgcattcttttctgtcctccaggacatgaggaatacaatcatggcatcaaaaaccatcgggacttctgaggagaagttgagaaagaaatcatcattctaccagtcttaccttcgaaggacacaatcaatgggaatccagctggaccagcgcattattgtgctttttatggtggactggggcaaagaagcagttgacagtttccatctaggcgatgatatggacccagagcttcggggtctggcacaggcattgattgaccagaaagtgaaggagatatccaatcaagagccactcaaactttaa

SEQ ID NO: 2594 - RNA, 1290 nt, synthetic construct
  misc_feature 1..1290: note = derived and/or modified CDS sequence (wt) from DOBV(A35)__GU904030.1__N
  source 1..1290: mol_type = other RNA
atggcaacattagaggaactccaaaaggaaatcaacaaccatgaaggtcaattggtgatagccaggcagaaggtgaaggatgcagaaaagcagtatgaaaaggaccctgacgacctgaataaaagggcattgagtgatcgggaaagcattgcacaatcaattcagggaaaaatcgatgaattaaggagacagctggctgatcgtgtggcagcagggaaaaacatcggcaaagaaagggacccaactgggctagaccctggagatcacctcaaagagaagtcaatgctcagttatggaaatgtcattgacctcaaccatcttgacattgatgaacctacagggcaaactgcagactggctaagcattgtgatctacctgacatcattcgtggtcccaatactgttgaaggctctttacatgcttaccaccagagggagacaaactactaaagacaataagggaatgaggattcgatttaaggatgacagctcttttgaagatgtgaatgggattcgaaagccaaagcacctgttcttgtcaatgcccaatgcacaatctagtatgaaggcagatgagattacaccaggtcggttcaggactgcaatctgtggactatacccagcccaggttaaggcaaggaatttaatcagtcctgtgatgagtgtgattgggtttgtagcccttgcaaaaaactggacagaacgggttgaagaatggcttgacctcccgtgcaagctactatctgagccatctccaacgtctttgaccaaaggcccatccaccaatcgtgactacttgaatcaaagacaaggagcgcttgcaaaaatggaaacgaaggaagctcaggctgtgaggaaacatgccatagatgctggttgcaacctcattgaccatatagactcaccatcatcaatctgggtctttgcaggagcacctgatagatgccctcctacctgcctgtttattgcaggcatggcagagctaggtgcattctttgctgtcctccaggacatgaggaacaccatcatggcatcaaaaaccatcggaacatctgaggaaaagctaaagaaaaagtcatctttttaccaatcttacctacggaggacacaatctatggggatacaactggaccagcgcatcattgtgctttttatggttgactggggaaaagaggcagttgatagttttcatctcggtgacgatatggatcctgagctccggggcctggcacaggcattgattgaccaaaaagtgaaggaaatatctaatcaggagccgcttaagctttaa

SEQ ID NO: 2595 - RNA, 1290 nt, synthetic construct
  misc_feature 1..1290: note = derived and/or modified CDS sequence (wt) from DOBV(3970/87)__L41916.1__N
  source 1..1290: mol_type = other RNA
atggcaacattagaggaactccaaaaggaaatcaacaaccatgaaggtcaattggtgatagccaggcagaaggtgaaggatgcagaaaagcagtatgaaaaggaccctgacgacctgaataaaagggcattgagtgatcgggaaagcattgcacaatcaattcagggaaaaatcgatgaattaaggagacagctggctgatcgtgtggcagcagggaaaaacatcggcaaagaaagggacccaactgggctagaccctggagatcacctcaaagagaagtcaatgctcagttatggaaatgtcattgacctcaaccatcttgacattgatgaacctacagggcaaactgcagactggctaagcattgtgatctacctgacatcattcgtggtcccaatactgttgaaggctctttacatgcttaccaccagagggagacaaactactaaagacaataagggaatgaggattcgatttaaggatgacagctcttttgaagatgtgaatgggattcgaaagccaaagcacctgttcttgtcaatgcccaatgcacaatctagtatgaaggcagatgagattacaccaggtcggttcaggactgcaatctgtggactatacccagcccaggttaaggcaaggaatttaatcagtcctgtgatgagtgtgattgggtttgtagcccttgcaaaaaactggacagaacgggttgaagaatggcttgacctcccgtgcaagctactatctgagccatctccaacgtctttgaccaaaggcccatccaccaatcgtgactacttgaatcaaagacaaggagcgcttgcaaaaatggaaacgaaggaagctcaggctgtgaggaaacatgccatagatgctggttgcaacctcattgaccatatagactcaccatcatcaatctgggtctttgcaggagcacctgatagatgccctcctacctgcctgtttattgcaggcatggcagagctaggtgcattctttgcttgcctccaggacatgaggaacaccatcatggcatcaaaaaccatcggaacatctgaggaaaagctaaagaaaaagtcatctttttaccaatcttacctacggaggacacaatctatggggatacaactggaccagcgcatcattgtgctttttatggttgactggggaaaagaggcagttgatagttttcatctcggtgacgatatggatcctgagctccggggcctggcacaggcattgattgaccaaaaagtgaaggaaatatctaatcaggagccgcttaagctttaa

SEQ ID NO: 2596 - RNA, 1290 nt, synthetic construct
  misc_feature 1..1290: note = derived and/or modified CDS sequence (wt) from DOBV(Klyuch-2000)__AF442622.1__N
  source 1..1290: mol_type = other RNA
atggcaacattggaggaactccaaaaggaaatcaacagccatgaaggccaactggtgatcgccaggcggaaggtgaaggatgcagaaaagcaatatgagaaggaccctgatgacctgaataaaagggcattaagcgatcgggaaagtgttgcacagtcaatccaagggaaaattgatgagttgcggagacagctggctgaccgtgtggctgcaggaaaaaatattggaaaagaaagggatccaactggactagaccctggtgatcatctcaaagagaagtcgatgctcagttacggaaatgtaattgatcttaatcacttggacattgatgaaccaacagggcaaactgctgactggttgagcattgtggtctatcttacatcatttgtggttccaatacttctgaaggctctttacatgctaacaaccagagggagacaaactactaaagacaataaagggatgaggattcgatttaaggatgacagttcttttgaggatgtgaacgggattcgaaagccaaagcacctgtttctgtcaatgcccaatgcacaatccagtatgaaagcagatgagatcacaccaggtcgattcaggactgcagtttgtggactatatccagctcaggttaaagcaaggaatttggtcagtcctgtaatgagtgtgattgggtttgtatccctcgctaaaaactggacagagcgggttgaggaatggcttgatctcccatgcaagctactatctgagccatctcccacgtctttgactaaaggcccatccactaatcgtgactacttgaatcaaagacagggggcgcttgcaaaaatggaaacaaaggaagctcaggctgtgaggaagcatgccataaatgctggttgtaaccttgttgatcacattgattcaccatcatcaatttgggtctttgcaggagcacctgatagatgcccccctacctgcttatttgttgcaggcatggcagagctaggtgcattttttgctgtccttcaagatatgaggaacaccatcatggcatcgaagactattgggacatcagaggagaagttgcggaagaaatcctctttctaccagtcatatcttagaagaacacaatctatgggaatacaactggatcagcgtattattgtgcttttcatggtggactggggtaaggaagcagttgacagtttccatcttggtgatgatatggacccagagcttcgaggcctggcacaggcactgattgagcaaaaagtgaaggagatatctaaccaggagccgcttaagctttaa

SEQ ID NO: 2597 - RNA, 1290 nt, synthetic construct
  misc_feature 1..1290: note = derived and/or modified CDS sequence (wt) from DOBV(10636/Ap)__KP878311.1__N
  source 1..1290: mol_type = other RNA
atggcaacattggaggaactccaaaaggaaatcaacaaccatgaaggccaactggtgatcgccaggcagaaggtgaaggatgcagaaaagcaatatgagaaggaccctgatgacctgaataaaagggcattaagcgatcgggaaagtgttgcacagtcaatccaagggaaaattgatgagttgcggagacagctggctgaccgtgtggccgcaggaaaaaatattggaaaagaaagggatccaactggactagaccctggtgatcatctcaaagagaagtcgatgctcagttacggaaatgtaattgatcttaatcacttggatattgatgaaccaacagggcaaactgctgactggctgagtattgtggtctatcttacatcatttgtggttccaatacttctgaaggctctttacatgctaacaactagagggagacaaactactaaagacaataaagggatgaggattcgatttaaggatgacagttcttttgaggatgtgaacgggattcgaaagccaaagcacctgtttctgtcaatgcccaatgcacaatccagtatgaaagcagatgagatcacaccaggtcgattcaggactgcagtttgtggactatatccagctcaggttaaagcaaggaatttggtcagtcctgtaatgagtgtgattgggtttgtatcccttgctaaaaactggacagagcgggttgaggaatggcttgatctcccatgcaagctactatctgagccatctcccacgtctttgactaaaggcccatccactaatcgtgactacttgaatcaaagacagggggcgcttgcaaaaatggaaaccaaggaagctcaggctgtaaggaagcatgccatagatgctggttgtaaccttgttgaccacattgattcaccatcatcaatttgggtctttgcaggagcacctgatagatgcccccctacctgcttatttgttgcaggcatggcagagctaggtgcattttttgctgtcctccaagatatgaggaacactatcatggcatcgaagactattgggacatcagaggagaagttgcggaagaaatcctctttctaccagtcatatcttagaagaacacaatctatgggaatacaactggatcagcgtattattgtgcttttcatggtggactggggtaaggaagcagttgacagttttcatcttggtgatgacatggatcctgagcttcgaagcctggcacaggcactgattgatcaaaaagtgaaggagatatctaaccaggagccgcttaagctttaa

SEQ ID NO: 2598 - RNA, 1290 nt, synthetic construct
  misc_feature 1..1290: note = derived and/or modified CDS sequence (wt) from DOBV(10645/Ap)__KP878312.1__N
  source 1..1290: mol_type = other RNA
atggcaacattggaggaactccaaaaggaaatcaacaaccatgaaggccaactggtgatcgccagacagaaggtgaaggatgcagaaaagcaatatgagaaggaccctgatgacctgaataaaagggcattaagtgatcgggaaagtgttgcacagtcaatccaagggaaaattgatgagttgcggagacagctggctgaccgtgtggccgcaggaaaaaatattggaaaagaaagggatccaactggactagaccctggtgatcatctcaaagagaagtcaatgctcagttacgggaatgtaattgatcttaatcacttggatattgatgaaccaacagggcaaactgctgactggctgagcattgtggtctatcttacatcatttgtggttccaatacttctgaaggctctttacatgctaacaaccagagggagacaaactactaaagacaacaaagggatgaggattcgattcaaggatgacagttcttttgaggatgtgaacgggattcgaaagccaaagcacctgtttctgtcaatgcccaatgcacaatccagtatgaaagcagatgagatcacaccaggtcgattcaggactgcagtttgtggactatatccagctcaggttaaagcaaggaatttggtcagtcctgtgatgagtgtgattgggtttgtatcccttgctaaaaactggacagagcgggttgaagaatggcttgatctcccatgcaagctactatctgagccatctcccacgtctttgactaaaggcccatccactaatcgtgactacttgaatcaaagacagggggcgcttgcaaaaatggaaacaaaggaagctcaggctgtaaggaaacatgccatagatgctggttgtaaccttgttgatcacattgattcaccatcatcaatttgggtttttgcaggagcacctgatagatgcccccctacctgcttatttgttgcaggcatggcagagctaggtgcattttttgctgtccttcaagatatgaggaacaccatcatggcatcgaagactattgggacatcagaggaaaagttgcggaagaaatcctctttctaccagtcatatcttagaagaacacaatctatgggaatacaactggatcagcgtattattgtgcttttcatggtggattggggtaaggaagcagttgacagtttccatcttggtgatgacatggatcctgagcttcgaggcctggcacaggcactgattgatcaaaaagtgaaggagatatctaaccaggagccgcttaagctttaa

SEQ ID NO: 2599 - RNA, 1290 nt, synthetic construct
  misc_feature 1..1290: note = derived and/or modified CDS sequence (wt) from DOBV(Aa1854/Lipetsk-02)__EU188452.1__N
  source 1..1290: mol_type = other RNA
atggcaacactagaggaactccaaaaggaaataaatagccatgagggccaactagtgatagccagacagaaagtaaaggatgcagaaaagcagtatgagaaagaccctgatgaccttaacaaaagggcactgagtgaccgggaaagcgttgcacagtcaatccagagtaaaattgacgaactaaggagacagctggctgaccgtgtggctgcagggaaaaacattggcaaagagagggatccaactggactagaccctggtgaccaccttaaagagaagtcaatgctcagttatgggaatgtcattgatctcaaccaccttgacattgatgaaccgactgggcaaactgctgattggctgagtattgtggtctatttgacatcttttgtggttccgatactcttaaaggctctttacatgttgacaaccagaggaaggcaaactactaaggacaataagggaatgaggattcgctttaaggatgacagctcattcgaggatgtaaatggaatccggaagccaaagcacctgttcttgtcaatgcctaatgctcaatccagcatgaaagcagatgagattacacctggccgattcaggactgcaatttgtggattatacccagctcaggtcaaagcaagaaatttggtcagtcctgtcatgagtgtgattggctttttagcccttgcaaagaactggacagaaagagttgaagagtggcttgaccttccatgcaagctactatctgagccatctccaacatctctgaccaaaggcccgtccaccaaccgtgattacttgaaccaacgacaagcagcacttgcaaaaatggagacaaaggaagctcaggctgtgagaaagcatgccatagatgctggttgtactatcattgatcacattgactcaccatcatcaatctgggtctttgctggggcacctgataggtgcccccccacctgcctgtttattgcaggcatggcagagttgggtgcatttttttctgtcctccaggacatgaggaatacaattatggcatcaaaacctgtcggaacttcagaggagaagctgaggaagaagtcatcattttatcaatcttacctccgaagaacacaatctatgggaatccagctggatcagcgcattattgtgcttttcatggtggactggggcaaagaagcagttgatagtttccatctaggtgatgatatggacccagagcttcggggcctggcacaggctttgattgaccagaaagtgaaggagatatctaaccaagagccgcttaagctttaa

SEQ ID NO: 2600 - RNA, 1290 nt, synthetic construct
  misc_feature 1..1290: note = derived and/or modified CDS sequence (wt) from DOBV(Ap/Sochi/43)__JF920151.1__N
  source 1..1290: mol_type = other RNA
atggcaacattggaggaactccaaaaggaaatcaacaaccatgaaggccaactggtgattgccagacagaaggtgaaggatgcagaaaagcaatatgagaaggaccctgatgacttgaataaaagggcattaagcgatcgggagagtgttgcacagtcaatccaagggaaaattgatgagttgcggagacagctggctgaccgtgtggccgcagggaaaaatattggaaaagaaagggatccaactggactagaccctggtgatcatctcaaagagaagtcgatgctcagttacggaaatgtgattgatcttaatcatttggatattgatgaaccaacagggcaaactgctgactggctgagtattgtggtctatcttacatcatttgtggttccaatacttctgaaagctctttacatgttaacaaccagagggagacaaactactaaagacaataaagggatgaggattcgattcaaggatgacagttcttttgaggatgtgaacgggattcgaaagccaaagcacctgtttctgtcaatgcccaatgcacaatccagtatgaaagcagatgagatcacaccaggtcgattcaggactgcagtttgtggactatatccagctcaggttaaagcaaggaatttggttagtcctgtaatgagtgtgattgggtttgtatctcttgctaaaaactggacagaacgggttgaggaatggcttgatctcccatgcaagctactatctgagccatctcccacgtctttgactaaaggcccatccactaatcgtgactacttgaatcaaagacagggagcgcttgcaaaaatggaaacaaaggaagctcaggctgtaaggaagcatgccatagatgctggttgtaaccttgttgatcacattgattcaccatcatcaatttgggtctttgcaggagcacctgataggtgcccccctacctgcttatttgttgcaggcatggcagagctaggtgcattttttgctgtccttcaagatatgaggaacaccatcatggcatcgaagactattggaacttcagaggagaagttgcggaagaaatcctctttctaccagtcatatcttagaagaacacactccatgggcatccaactggatcagcgtattattgttcttttcatggtggactggggtaaggaagcagttgacagtttccatcttggtgatgacatggatcctgagcttcgaggcctggcacaggcactgattgatcaaaaagtgaaggagatatctaaccaggaaccgcttaagctttaa

SEQ ID NO: 2601 - RNA, 1290 nt, synthetic construct
  misc_feature 1..1290: note = derived and/or modified CDS sequence (wt) from DOBV(Ap/Sochi/hu)__JF920150.1__N
  source 1..1290: mol_type = other RNA
atggcaacattggaggaactccaaaaggaaattaacaaccatgaaggccaactggtgatcgccagacagaaggtaaaggatgcagagaagcagtatgagaaggaccctgatgacctgaataaaagggcattaagcgatcgggaaagtgttgcacagtcaatccaagggaaaattgatgagttgcggagacagctggctgaccgtgtggctgcagggaaaaatattggaaaagaaagggatccaactggactagaccctggtgatcatctcaaagagaagtcgatgctcagttacgggaatgtaattgatcttaatcacttggatattgatgaaccaacagggcaaactgctgactggctgagcattgtggtctatcttacatcatttgtggttccaatacttctgaaggctctttacatgctaacaaccagagggagacaaactactaaagacaataaaggaatgaggattcggttcaaggatgacagttcttttgaggatgtgaacgggattcgaaagccaaagcacctgtttctgtcaatgcccaatgcgcaatccagtatgaaagcagatgagatcacaccaggtcgattcaggactgcagtttgtggactatatccagctcaggttaaagcaaggaatttggtcagtcctgtaatgagtgtgattgggtttctatcccttgctaaaaactggacagagcgggttgaggaatggcttgatctcccatgcaagctactatctgagccatctcccacgtctttgactaaaggcccatccactaatcgtgactacttgaatcaaagacagggggcgcttgcaaaaatggaaacaaaggaagctcaggctgtaaggaagcatgccatagatgctggttgtaaccttgttgatcacattgattcaccatcatcaatttgggtctttgcaggagcacctgatagatgcccccctacctgcttatttgttgcaggcatggcagagctaggtgcattttttgctgtccttcaagatatgaggaacaccatcatggcatcgaagactattgggacatcagaggagaagttgcggaagaaatcctctttctaccagtcatatcttagaagaacacactctatgggaatacaactggatcagcgtattattgtgcttttcatggtggactggggtaaggaagcagttgacagtttccatctcggtgatgacatggaccctgagcttcgaggcctggcacaggcactgattgatcagaaagtgaaggagatatctaatcaggagccgcttaagctttaa

SEQ ID NO: 2602 - RNA, 1290 nt, synthetic construct
  misc_feature 1..1290: note = derived and/or modified CDS sequence (wt) from DOBV(Ap1584/Sochi-01)__EU188449.1__N
  source 1..1290: mol_type = other RNA
atggcaacattggaggaactcaaaaaggaaattaacaaccatgaaggccaactggtgatcgccagacagaaggtaaaggatgcagaaaagcaatatgagaaggaccctgatgacctgaataaaagggcattaagcgatcgggaaagtgttgcacagtcaatccaagggaaaattgatgagttgcggagacagctggctgaccgtgtggctgcaggaaaaaatattggaaaagaaagggatccaactggactagaccctggtgatcatctcaaagagaagtcgatgctcagttacgggaatgtaattgatcttaatcacttggatattgatgaaccaacagggcaaactgctgactggctgagcattgtggtctatcttacatcatttgtggttccaatacttctgaaggctctttacatgctaacaaccagagggagacaaactactaaagacaataaaggaatgaggattcggttcaaggatgacagttcttttgaggatgtgaacgggattcgaaagccaaagcacctgtttctgtcaatgcccaatgcgcaatccagtatgaaagcagatgagatcacaccaggtcgattcaggactgcagtttgtggactatatccagctcaggttaaagcaaggaatttggtcagtcctgtaatgagtgtgattgggtttgtatcccttgctaaaaactggacagagcgggttgaggaatggcttgatctcccatgcaagctactatctgagccatctcccacgtctttgactaaaggcccatccactaatcgtgactacttgaatcaaagacagggggcgcttgcaaaaatggaaacaaaggaagctcaggctgtaaggaagcatgccatagatgctggttgtaaccttgttgatcacattgattcaccatcatcaatttgggtctttgcaggagcacctgatagatgcccccctacctgcttatttgttgcaggcatggcagagctaggtgcattttttgctgtccttcaagatatgaggaacaccatcatggcatcgaagactattgggacatcagaggagaagttgcggaagaaatcctctttctaccagtcatatcttagaagaacacaatctatgggaatacaactggatcagcgtattattgtgcttttcatggtggactggggtaaggaagcagttgacagtttccatctcggtgatgacatggaccctgagcttcgaggcctggcacaggcactgattgatcagaaagtgaaggagatatctaatcaggagccgcttaagctttaa

SEQ ID NO: 2603 - RNA, 1290 nt, synthetic construct
  misc_feature 1..1290: note = derived and/or modified CDS sequence (wt) from DOBV(DOB/Gola/235Af/07)__KC848495.1__N
  source 1..1290: mol_type = other RNA
atggcaacactagaggaactccaaaaagaaatcaacaaccacgaaggccaactggtaatagctaggcagaaggtgaaggatgcagaaaagcagtatgaaaaggaccctgacgacctgaataaaagggcattgagtgaccgggagagcattgcacaatcgattcagggaaaaatcgatgaattaaggaggcagctagctgatcgtgtggcagcagggaaaaacatcggcaaagaaagggatccaactgggctagaccctggagatcaccttaaagagaagtcaatgctcagttatggaaatgttattgacctcaaccaccttgacatcgatgaacctacagggcaaactgcagactggctaagcattgtggtctacctaacatcattcgtggttccaatactgttgaaggctctttacatgcttactaccagagggagacaaactactaaagacaataagggaatgaggattcgatttaaggatgacagctcttttgaagatgtgaatgggattcggaagccaaaacacctgttcttgtcaatgcccaacgcacaatctagcaggaaggcagatgagattacaccaggtcgtttcaggactgcaatttgtggactatacccagcccaagttaaggcaaggaacttaatcagtcctgtgatgagtgtgattgggtttttagcccttgcaaagaactggacagagcgggttgaagaatggcttgacctcccgtgcaagctactatctgagccatctccaacgtctttgaccaaaggcccatccaccaatcgtgactacttgaatcaaagacaaggagcgcttgcaaaaatggaaacaaaggaagcccaggctgtgaggaaacatgccatagatgctggttgcaaccttattgaccatatagactcaccatcatcaatctgggtctttgcaggagcacccgacagatgccctcctacctgcctgttcattgcaggcatggcagagctaggtgcattctttgctgtactccaggatatgaggaacaccatcatggcatcaaaaaccatcggaacatctgaggaaaagctaaagaaaaagtcatctttttaccaatcttacctacggaggacacaatctatggggatacaactggaccagcgcatcattgtgcttttcatggttgactgggggaaagaggcagttgatagttttcatctcggtgatgacatggatcctgaactccggggcctggcacaggcattgattgaccaaaaagtgaaggaaatatctaatcaggagccgcttaagctttaa

SEQ ID NO: 2604 - RNA, 1290 nt, synthetic construct
  misc_feature 1..1290: note = derived and/or modified CDS sequence (wt) from DOBV(DOB/Gola/343Af/07)__KC848498.1__N
  source 1..1290: mol_type = other RNA
atggcaacactagaggaactccaaaaagaaatcaacaaccacgaaggccaactggtaatagctaggcagaaggtgaaggatgcagaaaagcagtatgaaaaggaccctgacgacctgaataaaagggcattgagtgaccgggagagcattgcacaatcgattcagggaaaaatcgatgaattaaggaggcagctagctgatcgtgtggcagcagggaaaaacatcggcaaagaaagggatccaactgggctagaccctggagatcaccttaaagagaagtcaatgctcagttatggaaatgttattgacctcaaccaccttgacatcgatgaacctacagggcaaactgcagactggctaagcattgtggtctacctaacatcattcgtggttccaatactgttgaaggctctttacatgcttactaccagagggagacaaactactaaagacaataagggaatgaggattcgatttaaggatgacagctcttttgaagatgtgaatgggattcggaagccaaagcacctgttcttgtcaatgcccaacgcacaatctagcatgaaggcagatgagattacaccaggtcgtttcaggactgcaatttgtggactatacccagcccaggttaaggcaaggaacttaatcagtcctgtgatgagtgtgattgggtttttagcccttgcaaagaactggacagagcgggttgaagaatggcttgacctcccgtgcaagctactatctgagccatctccaacgtctttgaccaaaggcccatccaccaatcgtgactacttgaatcaaagacaaggagcgcttgcaaaaatggaaacaaaggaagcccaggctgtgaggaaacatgccacagatgctggttgcaaccttattgaccatatagactcaccatcatcaatctgggtctttgcaggagcacccgacagatgccctcctacctgcctgttcattgcaggcatggcagagctaggtgcattctttgctgtactccaggatatgaggaacaccatcatggcatcaaaaaccatcggaacatctgaggaaaagctaaagaaaaaatcatccttttaccaatcttacctacggaggacacaatctatggggatacaactggaccagcgcatcatcgtgcttttcatggttgactgggggaaagaggcagttgatagttttcatctcggtgatgacatggatcctgaactccggggcctggcacaggcattgattgaccaaaaagtgaaggaaatatctaatcaggagccgcttaagctttag

SEQ ID NO: 2605 - RNA, 1290 nt, synthetic construct
  misc_feature 1..1290: note = derived and/or modified CDS sequence (wt) from DOBV(DOB/Pecs/27Aa/06)__KC848499.1__N
  source 1..1290: mol_type = other RNA
atggcaacactagaggaactccagaaagagatcaatagccatgagggccaactggtgatagccaggcagaaggtgaaggatgcagaaaagcagtatgaaaaagaccctgatgacctaaacaaaagggcactgagtgaccgagaaagcgttgcacagtcaatccagagcaaaatcgatgaactaagaagacagctggctgaccgtgtagcagcaggaaaaaacattggtaaggaaagggatccaactggactagaccctggtgatcatcttaaagaaaaatcaatgctcagttatgggaacgtcattgacctcaaccaccttgacattgatgaaccaactgggcaaactgctgattggctgagcatcgtggtttacctaacatccttcgtggtcccgatactcctaaaagctctttacatgttaacaactagagggagacagacaactaaggacaacaagggaatgagggttcgctttaaggatgacagctcgtttgaagatgtgaatgggattcggaagccaaagcacctattcttgtcaatgcccaatgctcagtccagcatgaaggcagatgaaattacacctggccggttcagaactgcagtttgtggattatacccagctcaggtcaaggcaagaaatctggttagtcctgtcatgagtgtgattgggtttttggcccttgcaaagaactggacagaaagagttgaagagtggttggatcttccatgtaagctgctatctgaaccatctccaacatctttgaccaagggcccatctaccaaccgtgattacttaaaccaacgacaaggggcacttgcaaaaatggagacaaaagaagctcaggctgttagaaaacatgccatagatgctggttgtaacatcattgatcatatagactcaccatcatcaatctgggtttttgctggggcacctgataggtgcccccctacctgcctgtttattgcaggcatggcagagttaggtgcattcttttctgtcctacaggacatgagaaacacaatcatggcatcaaaaaccatcggaacttctgaggagaagctgaggaagaagtcatcattttaccagtcttatcttcgaaggacacagtctatgggaatccagctggatcagcgcattattgtgctttttatggtggactggggcaaagaagcagttgatagtttccatctgggtgatgacatggaccctgagcttcgaggtctggcacaggcattgattgaccagaaagtgaaggagatatctaatcaggagccgcttaagctttaa

SEQ ID NO: 2606 - RNA, 1290 nt, synthetic construct
  misc_feature 1..1290: note = derived and/or modified CDS sequence (wt) from DOBV(DOB/Pecs/31Aa/06)__KC848500.1__N
  source 1..1290: mol_type = other RNA
atggcaacactagaggaactccagaaagagatcaatagccatgagggccaactggtgatagccaggcagaaggtgaaggatgcagaaaagcagtatgaaaaagaccctgatgacctaaacaaaagggcactgagtgaccgagaaagcgttgcacagtcaatccagagcaaaatcgatgaattaagaagacagctggctgaccgtgtagcagcaggaaaaaacattggtaaggaaagggatccaactggactagaccctggtgatcatcttaaagaaaaatcaatgctcagttatgggaacgtcattgacctcaaccaccttgacattgatgaaccaactgggcaaactgctgattggctgagcatcgtggtttacctaacatccttcgtggtcccgatactcctaaaagctctttacatgttaacaactagagggagacagacaactaaggacaacaagggaatgaggattcgctttaaggatgacagctcgtttgaagatgtgaatgggatccggaagccaaagcacctattcttgtcaatgcccaatgctcagtccagcatgaaggcagatgaaattacacctggccggttcagaactgcagtttgtggattatacccagctcaggtcaaggcaagaaatctggttagtcctgtcatgagtgtgattggttttttggcccttgcaaagaactggacagaaagagttgaagagtggttggatcttccatgtaagctgctatctgaaccatctccaacatctttgaccaagggcccatctaccaaccgtgattacttaaaccaacgacaaggggcacttgcaaaaatggagacaaaagaagctcaggctgtgagaaaacatgccatagatgctggttgtaacatcattgatcacattgattcaccatcgtcaatctgggtttttgctggggcacctgataggtgcccccctacctgcctgtttattgcaggcatggcacagttaggtgcattcttttctgtcctacaggacatgagaaacacaatcatggcatcaaaaaccatcggaacttctgaggagaagctgaggaagaagtcatcgttttaccagtcttatcttcgaaggacacagtctatgggaatccagctggatcagcgcattattgtgctttttatggtggactggggcaaagaagcagttgatagtttccatctgggtgatgacatggaccctgagcttcgaggtctggcacaggcattgattgaccagaaaatgaaggaaatatctaatcaggagccgcttaagctttaa

SEQ ID NO: 2607 - RNA, 1290 nt, synthetic construct
  misc_feature 1..1290: note = derived and/or modified CDS sequence (wt) from DOBV(DOB/Sarmellek/77Aa/06)__KC848501.1__N
  source 1..1290: mol_type = other RNA
atggcaacactagaggaactccagaaagagatcaatagccacgagggccaactggtgatagccaggcagaaggtgaaggatgcagaaaagcagtatgaaaaagaccctgatgaccttaacaaaagggcattgagtgaccgggaaagcgttgcacagtcaatccagagcaagatcgatgaactaagaagacagctggctgaccgtgtggcttcaggaaaaaatattggtaaagaaagggatccaactggactagaccctggtgatcatcttacagaaaaatcaatgctcagttatgggaatgtcattgacctcaaccaccttgacattgatgagccaactgggcaaactgctgattggctgagcattgtggtctacctaacatccttcgtggtcccaatactcttaaaggctctttacatgttgacaactagagggagacagactactaaggataacaagggaatgaggattcgctttaaggatgacagctcgtttgaagatgtaaatgggattcgaaagccaaagcacctattcctgtcaatgcccaatgctcagtccagtatgaaggcagatgaaatcacacctggccggttcaggactgcaatttgtggattatacccagctcaagtcaaggcaagaaatttggtcagtcctgtcatgagtgtaattggttttttggctcttgcaaagaactggacagaaagagttgaagagtggttagatcttccatgtaagctactatctgagccatctccaacatctctgaccaagggcccatctaccaaccgtgattacttaaaccaacggcaaggagcacttgcaaaaatggagacaaaagaagctcaggctgtaaggaaacatgctatagatgctggttgtaacatcattgaccacattgattcaccatcatcaatctgggtgtttgctggggcacctgataggtgcccccctacctgcctgtttattgcaggtatggcagagttaggtgcattcttttctgtcctccaggacatgaggaatacaatcatggcatcaaaaaccgttggaacttctgaggagaagctgagaaagaagtcatcattttaccaatcttaccttagaaggacacagtctatgggaatccagctagatcagcgcattattgtgctttttatggtggactggggtaaagaagcagttgatagtttccatcttggtgatgacatggacccagagcttcggagtctggcacaggcattgattgaccagaaagtgaaggagatatccaatcaggagccgcttaagctttag

SEQ ID NO: 2608 - RNA, 1290 nt, synthetic construct
  misc_feature 1..1290: note = derived and/or modified CDS sequence (wt) from DOBV(GER/05/239/Aa)__GQ205405.1__N
  source 1..1290: mol_type = other RNA
atggcaacactagaggaactccaaaaagagatcaatagccacgagggccaactggtaatagccaggcagaaggtgaaggatgcagaaaagcagtatgagaaggaccctgacgaccttaataaaagggcattgagtgaccgagaaagcgttgcccaatcaattcagggcaagattgatgagttgaggagacagttagctgatcgtgtggctgcaggaaaaaacattggtaaggaaagggatccaactggactagaccctggtgaccacttgaaggagaaatcaatgctcagctatgggaatgtcattgaccttaaccaccttgacattgatgaaccaacagggcagactgctgattggttgagcattgtggtctacttgacatcttttgtggttccaatactattgaaggctctttacatgttgacaactagagggagacaaaccactaaggacaacaaagggatgagaattcgatttaaagatgacagctcgttcgaagatgtgaatggaatccggaagccaaagcacctatttttgtcaatgcctaatgcccagtccagcatgaaagcagatgaaattacacccggtcgattcaggactgcgatttgtgggttatatccggctcaggtcaaagcaagaaatttggtcagccctgtcatgagtgtaattggttttttggcccttgctaagaactggacagaacgggttgaagagtggcttgacctcccatgcaagctgctatctgagccatcaccaacatctttaaccaaaggcccgtccaccaatcgtgactacctgagccaaagacagggagcccttgcaaagatggaaacaaaggaagctcaggcagtgaggaaacatgctatagatgctggttgtaacatcattgaccacattgattcaccatcatcaatttgggtttttgctggggcacctgataggtgcccccccacctgcctttttattgcaggcatggcagagttaggtgcattctttgctgtcctccaggatatgaggaatacaattatggcatccaagactattgggacatcagaggagaagttaaggaagaaatcctcattttatcaatcttaccttcggaggacacaatccatgggaatccagctagatcagcgcattattgtgcttttcatggtggactggggaaaagaagcagttgacagcttccatctaggtgatgatatggatccagagcttcgaagccttgcacaggcattgattgaccagaaagtgaaggaaatatctaatcaagagccgcttaagctttaa

SEQ ID NO: 2609 - RNA, 1290 nt, synthetic construct
  misc_feature 1..1290: note = derived and/or modified CDS sequence (wt) from DOBV(GER/05/477/Af)__GQ205406.1__N
  source 1..1290: mol_type = other RNA
atggcaacactagaggaactccaaaaagagatcaatagccacgagggccaactggtaatagccaggcagaaggtgaaggatgcagaaaagcagtatgagaaggaccctgacgaccttaataaaagggcattgagtgaccgagaaagcgttgcccagtcaattcagggcaagattgatgagttgaggagacagttagctgatcgtgtggctgcaggaaaaaacattggtaaggagagggatccaactggactagaccctggtgaccacttgaaggagaaatcaatgctcagctatgggaatgtcattgaccttaaccaccttgacattgatgaaccaacagggcaaactgctgattggttgagcattgtggtctacttgacatcttttgtggttccaatactcttgaaggctctttacatgttgacaactagagggagacaaactactaaggacaacaaagggatgagaattcgatttaaggatgacagctcgttcgaagatgtgaatggaatccggaagccaaagcacctatttttgtcaatgcctaatgcccagtccagcatgaaagcagatgaaattacacccggtcgattcaggactgcgatttgtgggttatatccggctcaggtcaaagcaagaaatttggtcagccctgtcatgagtgtaattggttttttagcccttgctaagaactggacagaacgggttgaagagtggcttgacctcccatgcaagctgatatctgagccatcaccaacatctttaaccaaaggcccgtccaccaatcgtgactacctgagccaaagacagggagcccttgcaaagatggagacaaaggaagctcaggcagtgaggaaacatgctatagatgctggttgtaacatcatcgaccacattgattcaccatcatcaatttgggtttttgctggggcacctgataggtgcccccccacctgcctttttattgcaggcatggcagagttaggtgcattctttgctgtcctccaggatatgaggaatacaattatggcatccaagactattgggacatcagaggaaaagttaaggaagaaatcctcattttatcaatcttaccttcggaggacacaatctatgggaatccagctagatcagcgcattattgtgcttttcatggtagactggggaaaggaagcagttgacagcttccatctaggtgatgatatggatccagagcttcgaagccttgcacaggcattgattgaccagaaagtgaaggagatatctaatcaagagccgcttaagctttaa

SEQ ID NO: 2610 - RNA, 1290 nt, synthetic construct
  misc_feature 1..1290: note = derived and/or modified CDS sequence (wt) from DOBV(GER/07/293/Aa)__GQ205401.1__N
  source 1..1290: mol_type = other RNA
atggcaacactagaggaactccaaaaagagatcaatagccatgagggccaactggtgatagccaggcagaaggtgaaggatgcagaaaagcagtatgagaaggaccctgatgaccttaacaaaagagcattgagcgaccgggaaagcgttgcacagtcaattcagggcaagatcgatgaactaaggagacagctggctgaccgtgtagctgcagggaaaaacatcggcaaggagagggatccaactggactggaccctggtgatcacctgaaggagaaatcgatgctcagttatgggaatgttattgacctcaaccatctggacattgacgaaccaacagggcaaactgctgactggttaagcattgtggtctatttgacatcctttgtggttccaatactattgaaagctctttacatgttaacaactcgagggagacagactactaaggacaacaaggggatgagaattcggttcaaggatgacagctcgtttgaagatgtgaatgggatccggaaaccaaagcacttattcttgtcaatgcccaatgcccagtccagcatgaaagcagatgagattacacctggtcggtttaggactgcaatttgtggattatatccagctcaggtcaaagcgaggaacctggtcagccctgtcatgagtgtgattggtttcttagcccttgcaaagaactggacagaacgagttgaagattggcttgacctcccgtgcaagctgttatctgagccatcaccaacatctttaaccaaaggaccatcaaccaaccgtgattacctgaatcagaggcagggagcccttgcaaagatggagacaaaggaagctcaggctgtgaggaaacatgcaatagatgctggttgtaacatcattgaccacattgactcaccatcatcaatttgggtttttgctggggcacctgatagatgcccccctacctgcctgtttattgcaggcatggctgagttaggtgcattttttgctgtccttcaggatatgaggaatacaatcatggcatccaagactatcggaacatcggaagagaaactgaggaaaaaatcctcgttctatcaatcttaccttcggaggacacaatccatggggatccagctggaccaacgcattattgttctgctcatggtggactggggcaaagaagcagttgatagcttccatctaggtgatgatatggatccagagcttcggggcctggcacaggcactgattgaccagaaagtgaaggaaatatctaatcaagagccgcttaagctttaa

SEQ ID NO: 2611 - RNA, 1290 nt, synthetic construct
  misc_feature 1..1290: note = derived and/or modified CDS sequence (wt) from DOBV(GER/07/424/Aa)__GQ205403.1__N
  source 1..1290: mol_type = other RNA
atggcaacactagaggaactccaaaaagagatcaatagccatgagggccaactggtgatagccaggcagaaggtgaaggatgcagaaaagcagtatgagaaggaccctgatgaccttaacaaaagagcattgagcgaccgggaaagcgttgcacagtcaattcagggcaagatcgatgaactaaggagacagctggctgatcgtgtggccgcagggaaaaacatcggcaaggagagggatccaactggactggaccctggtgatcacctgaaggagaaatcgatgctcagttatgggaatgttattgacctcaaccatctggacattgatgaaccaacagggcaaactgctgactggttaagcattgtggtctatttgacatcctttgtggttccaatactattgaaagctctttacatgttaacaactcgaggaagacagactactaaggacaacaaagggatgagaattcgattcaaggatgacagctcgttcgaagatgtgaatgggatccggaaaccaaagcacttattcttgtcaatgcccaatgcccagtccagcatgaaagcagatgagatcacacctggccggtttaggactgcgatttgtggattatatccagctcaggtcaaagcgaggaacctggtcagccctgtcatgagtgtgattggtttcttagcccttgcaaagaactggacagaacgagttgaagattggcttgacctcccgtgcaagctgctatccgagccatcaccaacatctttaaccaaaggaccgtcaaccaaccgtgactacctgaatcagaggcagggagcccttgcaaagatggagacaaaggaagctcaggctgtgaggaaacatgcaatagatgctggttgtaacatcattgaccacattgactcaccatcatcaatttgggtttttgctggggcacctgatagatgcccccccacctgcctgtttattgcaggcatggctgagttaggtgcattttttgctgtccttcaggatatgaggaatacaatcatggcatccaagactatcggaacatcagaagagaaactgaggaaaaaatcctcgttctatcaatcttaccttcggaggacacaatccatggggatccagctggaccaacgcattattgttctgttcatggtggactggggcaaagaagcagttgatagcttccatctaggtgatgatatggatccagagcttcggggcctggcacaggcattgattgaccagaaagtgaaggaaatatctaatcaagagccgcttaagctttaa

SEQ ID NO: 2612 - RNA, 1290 nt, synthetic construct
  misc_feature 1..1290: note = derived and/or modified CDS sequence (wt) from DOBV(GER/08/118/Aa)__GQ205407.1__N
  source 1..1290: mol_type = other RNA
atggcaacactagaggaactccaaaaagagatcaatagccatgagggccaactggtgatagccaggcagaaggtgaaggatgcagaaaagcagtatgagaaggaccctgatgaccttaacaaaagagcattaagcgaccgggaaagcgttgcacagtcaattcagggcaagatcgatgaactaaggagacagctggctgaccgtgtagccgcaggaaaaaacatcggcaaggagagggatccaactggactggaccctggtgatcacctgaaggagaaatcaatgctcagttatgggaacgttattgacctcaaccatctggacattgacgaaccaacagggcaaactgctgactggttaagcattgtggtctatttgacatcctttgtggttccaatactattgaaagctctttacatgttaacaactcgagggagacagactactaaggacaacaaagggatgagaattcgattcaaggatgacagctcgtttgaagatgtgaatgggatccggaaaccaaagcacttattcttgtcaatgcccaatgcccagtccagcatgaaagcagatgagattacacctggtcggtttaggactgcaatttgtggattatatccagctcaggtcaaagcaaggaacctggtcagccctgtcatgagtgtgattggtttcttagcccttgcaaagaactggacagaacgagttgaagattggcttgacctcccgtgcaagctgctatccgagccatcaccaacatctttaaccaaaggaccatcaaccaaccgtgattacctgaatcaaaggcagggagccctcgcaaagatggagacaaaggaagctcaggctgtgaggaaacatgcaatagatgctggttgtaacatcattgaccacattgactcaccatcatcaatttgggtttttgctggggcacctgacagatgcccccctacctgcctgtttattgcaggcatggctgagttaggtgcattttttgctgtccttcaggatatgaggaatacaatcatggcatccaagactgtcggaacatcagaagaaaaaatgaggaaaaaatcctcgttctatcaatcttaccttcggaggacacaatccatggggatccagctggaccaacgcattattgttctgttcatggtggactggggtaaagaagcagttgatagctttcatctaggtgatgatatggatccagagcttcggggcctggcacaggcattgattgaccagaaagtgaaggaaatatctaatcaagagccacttaagctttaa

SEQ ID NO: 2613 - RNA, 1290 nt, synthetic construct
  misc_feature 1..1290: note = derived and/or modified CDS sequence (wt) from DOBV(GER/08/131/Af)__GQ205408.1__N
  source 1..1290: mol_type = other RNA
atggcaacactagaggaactccaaaaagagatcaatagccatgagggccaactggtgatagccaggcagaaggtgaaggatgcagaaaagcagtatgagaaggaccctgatgaccttaacaaaagagcattgagtgaccgagaaagcgttgcacagtcaattcagggtaaaatcgatgaactgaggagacagctggctgaccgtgtggctgcagggaaaaacatcggtaaggagagggatccaactggactggaccctggtgatcacctgaaggagaaatcaatgctcagttacgggaatgtaatcgaccttaaccatctggacattgatgaaccgacagggcaaactgctgactggctaagcattgtggtctatctgacatcttttgtggttccaatactattgaaagctctttacatgttaacaactaggggaagacagactactaaggacaacaaagggatgagaattcgattcaaggatgacagctcatttgaagatgtgaatgggatccggaagccaaagcacttattcttgtcaatgcccaatgcccagtccagtatgaaagcagatgagattacacctggtcggtttaggactgcagtttgtggattatatccagctcaggtcaaagcaaggaacctggttagccctgtcatgagtgtgattggctttttagcccttgcaaagaactggacagaacgggttgaagactggcttgacctcccatgcaagctgctatctgagccatcaccgacatctttgaccaaaggcccatcaaccaaccgtgactacctgaatcaaaggcagggagcccttgcaaagatggaaacaaaggaagctcaggctgtgaggaaacatgccatagatgctggttgtaacatcattgaccacattgactcaccatcatcaatttgggtttttgctggagcacctgatagatgcccccccacctgcctgttcattgcaggcatggctgagttaggtgcattctttgctgtccttcaggatatgaggaatacaatcatggcatccaagactatcgggacatcagaagagaagctgaggaagaaatcctcattttatcaatcttaccttcgaaggacacagtctatggggatccagctggaccagcgcattattgttctgttcatggtggactggggcaaagaggcagttgacagcttccatctaggtgatgacatggatccagagcttcggggcctggcacaggcattgattgaccaaaaagtgaaggagatatctaatcaggagccgcttaagctttaa

SEQ ID NO: 2614 - RNA, 1290 nt, synthetic construct
  misc_feature 1..1290: note = derived and/or modified CDS sequence (wt) from HTNV(76-118/POR)__KT885049.1__N
  source 1..1290: mol_type = other RNA
atggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaa

SEQ ID NO: 2615 - RNA, 1290 nt, synthetic construct
  misc_feature 1..1290: note = derived and/or modified CDS sequence (wt) from HTNV(A16)__AF288646.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagagcattaacagacagggaagggcttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccaaatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcatagtgctctttatggttgcctggggtaaagaggctgtggataatttccaccttggagatgatatggatcctgtgctaaggacattggcacaaagcctgattgatgtaaaagtgaaggaaatctctaaccaagagcctttaaaactataa

SEQ ID NO: 2616 - RNA, 1290 nt, synthetic construct
  misc_feature 1..1290: note = derived and/or modified CDS sequence (wt) from HTNV(CA09082007)__HQ834499.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagagcattaacagacagggaaggggttgcagcatcaatccaggccaagattgatgaactaaaaaggcagctagcagataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagagggaggcagacaactaaagataacaaagggaccaggattcgattcaaggatgacagctcttttgaggatgtcaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagcctccatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggggcaccagatcgctgtccaccgacatgcttgtttattgcagggattgctgaacttggcgcattcttctccattttacaggacatgcgaaacacaattatggcctcaaagacagtgggaacatctgaggaaaagctacggaagaaatcatcattctatcagtcttatatcaggcgaacccaatcaatgggaatacaactggaccaaagaatcatagtgctctttatggtcgcctggggtaaagaggctgtggataatttccaccttggagatgatatggatcctgagctaaggacattggcacaaagcctgattgatctaaaagtgaaggaaatctctaaccaagagcctttaaaactataa

SEQ ID NO: 2617 - RNA, 1290 nt, synthetic construct
  misc_feature 1..1290: note = derived and/or modified CDS sequence (wt) from HTNV(CA10081109)__HQ834500.1__N
  source 1..1290: mol_type = other RNA
atgccgactagtggggaactgcagagggaaatcaatgcccatgaaggccaactggtgatagccaggcagaaggtgagggatgcagaaaaacaatatgagaaggatccagatgaactgaacaaaagagcattaacagatagggaaggggttgcagcatcaatccaggccaagattgatgaactgaaaaggcagctagcggataggattgcaactggaaaaaaccttggaaaggaacaggatcccactggagtagaacctggagaccatctgaaagagagatcaatgctcagttatggaaatgtattggacttgaaccatctggatattgatgagcctactgggcagactgcagactggcttagtattgttatatatctaacatcttttgttgtcccgatacttctgaaggccttatatatgctcacaacaagagggaggcagacaaccaaagataacaaagggaccaggattcgattcaaggatgacagctcttttgaggatgttaacgggattcgaaagccaaagcatctatatgtgtccttgcccaatgcccaatcgagcatgaaggcagaagagatcacaccgggtaggtacagaacagcaatctgtgaactctatcctgcacagatcaaagccagcaaaatgattagccctgtcatgagtgtaatcggatttttggcgctggcaaaagattggagtgaccgtattgaacagtggttaagtgaaccttgtaagctactcccggatacagcagcagtaagccttcatggaggccctgcaacaaacagggattacctacggcagcgccaggtagcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcttgtttattgcagggattgctgaacttggtgcattcttctctattttacaggacatgcgaaacacaattatggcctcaaagacagtgggaacatctgaggaaaagctacggaagaaatcatcattctatcagtcttatctcaggcgaacccaatctatgggaatacaactggaccaaagaattatagtgctctttatggttgcctggggtaaagaggctgtggataatccccacgcaggagatgatgtagatccatcgctaggaatgctggcacaaagcctgattgatgtaaaagtgaaggaaatctctaaccaagagcctttaaaactgtaa

SEQ ID NO: 2618 - RNA, 1290 nt, synthetic construct
  misc_feature 1..1290: note = derived and/or modified CDS sequence (wt) from HTNV(CA10081113)__HQ834501.1__N
  source 1..1290: mol_type = other RNA
atggcgactagtggggaactgcagagggaaatcaatgcccatgaaggccaactggtgatagccaggcagaaggtgagggatgcagaaaaacaatatgagaaggatccggatgaactgaacaagagagcattaacagacagggaaggggttgcagcatcaatccaggccaagattgatgaactgaaaaggcagctagcggataggattgcaactggaaaaaaccttggaaaggaacaggatcccactggagtagaacctggagaccatctgaaagagagatcaatgctcagttatggaaatgtattggacttgaaccatctggatattgatgagcctactgggcagactgcagactggcttagtattgttatatatctgacatcttttgttgtcccgatacttctgaaggccttatatatgcttacaacaagagggaggcagacaaccaaagataacaaagggaccaggattcgattcaaggatgacagctcttttgaggatgttaacgggattcgaaagccaaagcatctgtatgtgtcattgcccaatgcccaatcgagcatgaaggcagaagagatcacaccgggtaggtacagaacagcaatctttgaactctatcctgcacagatcaaagccagacaaatgattagccctgtcatgagtgtaatcggatttttggcgctggcaaaagattggagtgaccgtattgaacagtggttaagtgaaccctgtaagctactcccggatacagcagcagtaagcctccatggaggtcctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcttgtttattgcagggattgctgaacttggtgcattcttctccattttacaggacatgcgaaacacaattatggcctcaaagacagtgggaacatctgaggagaagctacggaagaaatcatcattctatcaatcttatctcaggcgaacccaatcaatgggaatacaactggaccaaagaattatagtgctctttatggttgcctggggtaaagaggctgtggataatcgccacttgatgaatatcgtggatcctgagccaagggcgctggcacaaagcctgattgatgtaaaagtgaaggaaatctctaaccaagagcctttaaaactataa

SEQ ID NO: 2619 - RNA, 1290 nt, synthetic construct
  misc_feature 1..1290: note = derived and/or modified CDS sequence (wt) from HTNV(CA10081203)__HQ834502.1__N
  source 1..1290: mol_type = other RNA
atggcgactaatggggaactgcagagggaaatcaatgcccatgaaggccaactggtgatagccaggcagaaggtgagggatgcagaaaaacaatatgagaaggatccagatgaactgaacaagagagcattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactggacagactgcagactggcttagtattgttatatatctgacatcttttgttgtcccgatacttctgaaggccttatatatgctcacaacaagagggaggcagacaaccaaagataacaaagggaccaggattcgattcaaggatgacagctcttttgaggatgtcaacgggattcgaaagccaaagcatctatatgtgtccttgcccaatgcccaatcaagcatgaaggcagaagagatcacaccaggtaggtacagaacagcaatctttggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagcctccatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggggcaccagatcgctgtccaccgacatgcttgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcatagtgctctttatggtcgcctggggtaaagaggctgtggatgaactccactcgggagatggtgagcatcatgcatcaaggacattggcacaaagcctgattgatgtaaaagtgaaggaaatctctaaccaagagcctttaaaactataa

SEQ ID NO: 2620 - RNA, 1290 nt, synthetic construct
  misc_feature 1..1290: note = derived and/or modified CDS sequence (wt) from HTNV(CA10081206)__HQ834503.1__N
  source 1..1290: mol_type = other RNA
atggcgactattgaggaactgcagagggaaatcaatgcccatgaaggccaactggtgatagccaggcagaaggtgagggatgcagaaaaacaatatgagaaggatccagatgaactgaacaagagagcattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactggacagactgcagactggcttagtattgttatatatctgacatcttttgttgtcccgatacttctgaaggccttatatatgctcacaacaagagggaggcagacaaccaaagataacaaagggaccaggattcgattcaaggatgacagctcttttgaggatgtcaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagcctccatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggggcaccagatcgctgtccaccgacatgcttgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcatagtgctctttatggtcgcctggggtaaagaggctgtggataatttccacgcgtgggatggtatggatcctgagctaaggacattggcacaaagcctgattgatgtaaaagtgaaggaaatctctaaccaagagcctttaaaactataa

SEQ ID NO: 2621 - RNA, 1290 nt, synthetic construct
  misc_feature 1..1290: note = derived and/or modified CDS sequence (wt) from HTNV(CA10081708)__HQ834504.1__N
  source 1..1290: mol_type = other RNA
atgccgactagtggggaactgcagagggaaatcaatgcccatgaaggccaactggtgatagccaggcagaaggtgagggatgcagaaaaacaatatgagaaggatccggatgaactgaataagagagcattaacagacagggaaggggttgcagcatcaatccaggccaagattgatgaactgaaaaggcagctagcggataggattgcaactggaaaaaaccttggaaaggaacaggatcccactggggtagaacctggagaccatctgaaagagagatcaatgcttagttatggaaatgtattggacttgaatcatctggatattgatgagcctactgggcagactgcagattggcttagtattgttatatatctgacatcttttgttgtcccgatacttctgaaggccttatatatgcttacaacaagagggaggcagacaaccaaagataacaaaggaaccaggattcgattcaaggatgacagctcttttgaggatgttaacgggattcgaaagccaaagcatctatatgtgtccttgcccaatgcccaatcgagcatgaaggcagaagagatcacaccgggtaggtacagaacagcaatctttgaactctatcctgcacagatcaaagccagaaaaatgattagccctgtcatgagtgtaatcggatttttggcgctggcaaaagattggagtgaccgtattgaacagtggttaagtgaaccttgtaagctacttccggatacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcttgtttattgcagggattgctgaacttggtgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaattatagtgctctttatggttgcctggggtaaagaggctgtggataatccccacaccggagatgatgcagaccctgagctaagaacgctggcacaaagcctgattgatgtaaaagtgaaggaaatctctaaccaagagcctttaaaactataa

SEQ ID NO: 2622 - RNA, 1290 nt, synthetic construct
  misc_feature 1..1290: note = derived and/or modified CDS sequence (wt) from HTNV(CA10081905)__HQ834505.1__N
  source 1..1290: mol_type = other RNA
atggcgactagtggggaactgcagagggaaatcaatgcccatgaaggccaactggtgatagccaggcagaaggtgagggatgcagaaaaacaatatgagaaggatccggatgaactgaacaagagagcattaacagacagggaaggggttgcagcatcaatccaggccaagattgatgaactgaaaaggcagctagcggataggattgcaactggaaaaaaccttggaaaggaacaggatcccactggagtagaacctggagaccatctgaaagagagatcaatgctcagttatggaaatgtattggacttgaaccatctggatattgatgagcctactgggcagactgcagactggcttagtattgttatatatctgacatcttttgttgtcccgatacttctgaaggccttatatatgcttacaacaagagggaggcagacaaccaaagataacaaagggaccaggattcgattcaaggatgacagctcttttgaggatgttaacgggattcgaaagccaaagcatctgtatgtgtcattgcccaatgcccaatcgagcatgaaggcagaagagatcacaccgggtaggtacagaacagcaatctttgaactctatcctgcacagatcaaagccagaaaaatgattagccctgtcatgagtgtaatcggatttttggcgctggcaaaagattggagtgaccgtattgaacagtggttaagtgaaccttgtaagctactcccggatacagcagcagtaagcctccatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcttgtttattgcagggattgctgaacttggtgcattcttctccattttacaggacatgcgaaacacaattatggcctcaaagacagtgggaacatctgaggagaagctacggaaaaaatcatcattctatcaatcttatctcaggcgaacccaatcaatgggaatacaactggaccaaagaattatagtgctctttatggttgcctggggtaaagaggctgtggataatcaccacttgataaatgctggggatcatgagctaaggacgctggcacaaagcctgattgatgtaaaagtgaaggaaatctctaaccaagagcctttaaaactataa

SEQ ID NO: 2623 - RNA, 1290 nt, synthetic construct
  misc_feature 1..1290: note = derived and/or modified CDS sequence (wt) from HTNV(E142)__AF288644.1__N
  source 1..1290: mol_type = other RNA
atggcaactatggaggaactgcagagggaaatcaatgcccatgagggtcaactggtgatagccaggcagaaggtgagggatgcagaaaaacgatatgaaaaggatccagatgagctgaataaaagaacattaacagacagagaaggggttgcagcatctatccaggccaagattgatgaattgaaaaggcagttagcagataggattgcaaccggaaagaaccttgggaaagaacaggatcccacaggggttgagcctggagaccatctgaaagagagatcaatgcttagttatggaaatgtattggatttgaaccacctggatattgatgagcctactggacagactgcagattggctcagtattgttatatatttaacatcctttgttgtcccaatacttctaaaggccctatatatgcttacaacaagagggaggcagacaaccaaagataataaagggactaggattcgattcaaggatgacagctcctctgaggatgttaacgggattcggaaaccaaaacatttatatgtttccttgcccaatgcccagtcaagcatgaaggcagaagagatcacaccagggagatacaggacagcaatctgtggactctaccctgcacagattaaggctagacagatgatcagccctgtcatgagtgttattggatttttggctctggcaaaagattggagtgaccgtattgagcagtggctaagtgaaccctgtaagctactcccagatacagcagcagtaagtctccacgggggccctgcaacaaacagggattacctacggcagcgccaagtggcattgggcaatatggaaacaaaagagtcaaaggctatacgtcaacatgctgaatctgcaggttgtagcatgattgaggacattgaatcaccatcatcgatatgggtgtttgctggagcaccagaccgctgtccgccaacatgcttatttattgcagggattgctgaacttggagcattcttttcaatcttacaggacatgcggaataccattatggcatcaaagacagtaggaacatctgaagagaaattacggaaaaaatcatcattctatcagtcttatctcaggcgaacacaatcaatgggaatacaactggaccagaggattatagtgctattcatggttgcctggggtaaagaggtagtggataacttccaccttggagatgacatggatcctgagttgagaacattggcacaaagcttgattgatgttaaagtgaaggaaatctccaaccaagagcctttaaaactataa

SEQ ID NO: 2624 - RNA, 1290 nt, synthetic construct
  misc_feature 1..1290: note = derived and/or modified CDS sequence (wt) from HTNV(H10150)__HQ834506.1__N
  source 1..1290: mol_type = other RNA
atggcaactatgggggaattgcagagggaaatcaatgcccatgaaggccaactggtgatagccaggcagaaggtgagggatgcagaaaaacaatatgagaaggatccagatgaactgaacaagagagcattaacagacagggaaggggttgcagcatcaatccaggccaagattgatgaactgaaaaggcagctagcggataggattgcaactggaaaaaaccttggaaaggaacaggatcccactggagtagaacctggagaccatctgaaagagagatcaatgctcagttacggaaatgtattggacttgaaccatctggatattgatgagcctactgggcagactgcagactggcttagtattgttatatatctgacatcttttgttgtcccgatacttctgaaggccttatatatgctcacaacaagagggaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccgggtaggtacagaacagcaatctttggactctatcctgcacagatcaaagccagacaaatgattagccctgtcatgagtgtaatcggatttttggcgctggcaaaagattggagtgaccgtattgaacagtggttaagtgaaccttgtaagctactcccggatacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcttgtttattgcagggattgctgaacttggtgcattcttctccattttacaggacatgcgaaacacaattatggcctcaaagacagtggggacatctgaggaaaagctacggaagaaatcatcattctatcagtcttatctcaggcgaacccaatcaatgggaatacaactggaccaaagaattatagtgctctttatggttgcctggggtaaagaggctgtggataatcaccactgggcaaatgctattggatctgagttaaggacgctggcacaaagccttattgatgtaaaagtgaaggaaatctctaaccaagagcctttaaaactgtaa

SEQ ID NO: 2625 - RNA, 1290 nt, synthetic construct
  misc_feature 1..1290: note = derived and/or modified CDS sequence (wt) from HTNV(Aa03-161)__KT935024.1__N
  source 1..1290: mol_type = other RNA
atggcaactatggaggaattacagagggaaatcaatgcccatgagggtcaacttgtgatagccaggcagaaggtgagggatgcagaaaaacagtatgaaaaggatccagatgagttgaacaagagagcattaacagaccgagagggtgttgcagtatctatccaggcaaagattgatgagttaaagaggcaactggcagataggattgcaactgggaaaaaccttgggaaggaacaagatccaacaggggtagagcctggagaccatctgaaagagagatcaatgctcagttatggtaatgtgctggatttaaaccatttggatattgatgaacccacaggacagacagcagactggctaagcattgttgtctatcttacatcctttgttgtcccgatacttctgaaagctctatatatgttgacaacaagggggaggcaaactaccaaggataacaaaggaactcggattcgatttaaggatgatagctcgttcgaggacgttaacggtatccgaaagccaaaacatctttatgtgtccttgccaaatgcacagtcaagtatgaaggcagaagagattacacctggtagatatagaacagcagtctgtggactctaccctgcacagatcaaggcacggcagatgatcagcccagtcatgagtgtgattggttttctggcattggcaaaggattggagtgatcgtattgaacaatggttaagtgaaccttgcaagctccttccagatgcagcagcagttagcctccttggtggtcctgcaacaaacagggactacttacggcagcggcaagtggcattaggcaatatggagacaaaagagtcaaaggctatacgccagcatgcagaagcagctggctgtagcatgattgaggatattgagtcaccatcatcaatatgggtatttgctggagcaccagaccgttgtccaccaacatgtttgttcatagcaggtattgctgagcttggggcatttttttccatcctgcaggacatgcgaaatacaatcatggcatctaagacagttgggacatctgaggagaagcttcgaaagaaatcatcattctatcagtcttatctcagaaggacacaatcaatggggatacaactggaccaaaggatcattgtgctctttatggttgcttggggaaaggaggctgtggacaatttccacttaggggatgatatggatcctgagctaagaacactggcacaaagcttgattgatgtcaaagtgaaggaaatctccaaccaagagcctttaaaactctaa

SEQ ID NO: 2626 - RNA, 1290 nt, synthetic construct
  misc_feature 1..1290: note = derived and/or modified CDS sequence (wt) from HTNV(Aa04-722)__KU207190.1__N
  source 1..1290: mol_type = other RNA
atggcaactatggaggaattacagagggaaatcaatgcccatgagggtcaacttgtgatagccaggcagaaggtgagggatgcagaaagacagtatgaaaaggatccagatgagttgaacaagagagcattaacagaccgagagggtgttgcagtatctatccaggcaaagattgatgagttaaagaggcagctggcagataggattgcaactgggaaaaaccttgggaaggaacaagatccaacaggggtagagcctggagaccatctgaaagagagatcaatgctcagttatggtaatgtgctggatttaaaccatttggatattgatgaacccacaggacagacagcagactggttaagcattgttgtctatcttacatcctttgttgtcccgatacttctgaaagctctatatatgttaacaacaagggggaggcaaactaccaaggataacaaaggaactcggattcgatttaaggatgatagctcgttcgaggatgttaacggtatccggaaaccaaaacatctttatgtgtccttgccaaatgcacagtcaagtatgaaggcagaagagattacacctggtagatatagaacagcagtctgtggactctaccctgcacagatcaaggcacggcagatgatcagcccagtcatgagtgtgattggttttctggcattggcaaaggattggagtgatcgtattgaacaatggttaagcgaaccttgcaagctccttccagatacagcagcagttagcctccttggtggtcctgcaacaaacagggactacttacggcagcggcaagtggcattaggcaatatggagacaaaagagtcaaaggctatacgccagcatgcagaagcagctggctgtagcatgattgaggacattgagtcaccatcatcaatatgggtatttgctggagcaccagaccgttgtccaccaacatgtttgtttatagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggattattgtgctctttatggttgcttggggaaaggaggctgtggacaacttccacttaggggatgatatggatcctgagctaagaacactggcacagagcttgattgatgtcaaagtgaaggaaatctccaaccaagagcctttaaaactctaa

SEQ ID NO: 2627 - RNA, 1290 nt, synthetic construct
  misc_feature 1..1290: note = derived and/or modified CDS sequence (wt) from HTNV(Aa05-190)__KT935027.1__N
  source 1..1290: mol_type = other RNA
atggcaactatggaggaactacagagggaaatcaatgcccatgagggtcaacttgtgatagccaggcagaaggtgagggatgcagaaaaacagtatgaaaaggatccggatgagttgaacaagagagcattaacagaccgagagggtgttgcagtatctatccaggcaaagattgatgagttaaagaggcagctggcagataggattgcaaccgggaaaaaccttgggaaagaacaagatccaacaggggtagagcctggagaccatctgaaagagagatcaatgctcagttatggtaatgtgctggatttaaaccatttggatattgatgaacccacaggacagacagcagactggctaagcattgttgtctatcttacatcctttgttgtcccgatacttctgaaagctctatatatgttgacaacaagggggaggcaaactaccaaggataacaaaggaactcggattcgatttaaggatgatagctcgttcgaggacgttaatggtatccgaaaaccaaaacatctttatgtgtccttgccaaatgcacagtcaagtatgaaggcagaagagattacacctggtagatatagaacagcagtctgtgggctctaccctgcacagatcaaggcacggcagatgatcagcccagtcatgagtgtgattggttttctggcattggcaaaggattggagtgatcgtattgaacaatggttaagcgaaccttgcaagctccttccagatacagcagcagttagcctccttggtggtcctgcaacaaacagggactacttacggcagcgacaagtggcattaggcaatatggagacaaaagagtcaaaggctatacgccagcatgctgaagcagctggctgtagcatgattgaggacattgagtcaccatcatcaatatgggtatttgctggagcaccagaccgttgcccaccaacatgtttgtttatagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggatcattgtgctctttatggttgcttggggaaaggaggctgtggacaacttccacttaggggatgatatggatcctgagctaagaacactggcacagagtttgattgatgtcaaagtgaaggaaatctccaaccaagagcctttaaaactctaa

SEQ ID NO: 2628 - RNA, 1290 nt, synthetic construct
  misc_feature 1..1290: note = derived and/or modified CDS sequence (wt) from HTNV(Aa10-123)__KT935036.1__N
  source 1..1290: mol_type = other RNA
atggcaactatggaagaattacagagggaaatcaatgcccatgagggtcaacttgtgatagccaggcagaaggtgagggatgcagaaaaacagtatgaaaaggatccggatgagttgaacaagagagcattaacagaccgagagggtgttgcagtatctatccaggcaaagattgatgagttaaagaggcagctggcagataggattgcaactgggaaaaatcttgggaaggaacaagatccaacaggggtagagcctggagaccatctgaaagaaagatcaatgctcagttatggtaatgtgctggatttaaaccatttggatattgatgaacccacaggacagacagcagactggctaagcattgttgtctatcttacatcctttgttgtcccgatacttctgaaagctctatatatgttaacaacaagggggaggcaaactaccaaggataacaaaggaactcggattcgatttaaggatgatagctcgttcgaggacgttaatggcatccgaaaaccaaaacatctttatgtgtccttgccaaatgcacagtcaagtatgaaggcagaagagattacacctggtagatatagaacagcagtctgtggactttaccctgcacagatcaaggcacggcagatgatcagcccagtcatgagtgtgattggtttcctggcattggcaaaggattggagtgatcgtattgaacaatggttaagcgaaccttgcaagctccttccagatacaacagcagttagcctccttggtggtcctgcaacaaatagggactacttacggcagcggcaagtggcattaggcaatatggagacaaaagagtcaaaggctatacgccagcatgcagaagcagctggctgtagcatgattgaggacattgagtcaccatcttcaatatgggtatttgctggagcaccagaccgttgtccaccaacatgtttgtttgtagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggatcattgtgctctttatggttgcttggggaaaggaggctgtggacaacttccacttaggggatgatatggatcctgagctaagaacactagcacagagcttgattgatgtcaaagtgaaggaaatctccaaccaagagcctttaaaactctaa

SEQ ID NO: 2629 - RNA, 1290 nt, synthetic construct
  misc_feature 1..1290: note = derived and/or modified CDS sequence (wt) from HTNV(Aa10-265)__KU207194.1__N
  source 1..1290: mol_type = other RNA
atggcaactatggaagaactacagagggaaatcaatgcccatgagggtcaacttgtgatagccaggcagaaggtgagggatgcagaaaaacagtatgaaaaggatccggatgagttgaacaagagagcattaacagaccgagagggtgttgcagtatctatccaggcaaagattgatgagttaaagaggcagctggcagataggattgcaactgggaaaaatcttgggaaggaacaagatccaacaggggtagagcctggagaccatctgaaagaaagatcaatgctcagttatggtaatgtgctggatttaaaccatttggatattgatgaacccacaggacagacagcagactggctaagcattgttgtctatcttacatcctttgttgtcccgatacttctgaaagctctatatatgttaacaacaagggggaggcaaactaccaaggataacaaaggaactcggattcgatttaaggatgatagctcgttcgaggacgttaatggcatccgaaaaccaaaacatctttatgtgtccttgccaaatgcacagtcaagtatgaaggcagaagagattacacctggtagatatagaacagcagtctgtggactttaccctgcacagatcaaggcacggcagatgatcagcccagtcatgagtgtgattggtttcctggcattggcaaaggattggagtgatcgtattgaacaatggttaagcgaaccttgcaagctccttccagatacagcagcagttagcctccttggtggtcctgcaacaaacagggactacttacggcagcggcaagtggcattaggcaatatggagacaaaagagtcaaaggctatacgccagcatgcagaagcagctggctgtagcatgattgaggacattgagtcaccatcttcaatatgggtatttgctggagcaccagaccgttgtccaccaacatgtttgtttgtagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggatcattgtgctctttatggttgcttggggaaaggaggctgtggacaacttccacttaggggatgatatggatcctgagctaagaacactagcacagagcttgattgatgtcaaagtgaaggaaatctccaaccaagagcctttaaaactctaa

SEQ ID NO: 2630 - RNA, 1290 nt, synthetic construct
  misc_feature 1..1290: note = derived and/or modified CDS sequence (wt) from HTNV(AA1028)__AF427318.1__N
  source 1..1290: mol_type = other RNA
atggcaactatggaggaattgcagagggaaatcaatgcccacgagggtcaactggtgatagccaggcagaaggttagggatgcagaaaagcagtatgaaaaggatccagatgagttaaacaagagagcattgacagatcgagagggtgttgcagtatccatccaagcaaagattgatgaattaaagaggcaactggcagaccggatcgcaaccgggaagaatcttggaaaggaacaagacccaacaggggtagaacctggagatcatctgaaagagagatcaatgctcagttatggaaatgttcttgacttaaaccacctggatattgatgagccgacaggacagacagcagactggctgagcattgttgtctatcttacatcctttgttgtcccaatacttctgaaagctctgtatatgttaacaacaagggggaggcagaccaccaaggacaataagggaactcggattcgattcaaggatgatagttccttcgaggatgtcaatggcatccggaagccaaaacatctatatgtgtccttgccaaatgcacagtcaagtatgaaagcagaagagattacacctggtagatatagaacagcaatttgtgggctttatcctgcacaaattaaggcaagacagatgattagtcctgtcatgagtgtgatcggattcctggctctggcaaaagattggagtgaccgcattgagcagtggttaagtgaaccctgtaagcttcttccagacacagcagcagttagcctccttggtggtcctgctaccaacagggactacctacggcagcggcaagtggcattaggcaatatggaaacaaaagagtctaaggctatacgccaacatgcagaggcagcaggctgtagcatgattgaggacattgagtcaccatcctcaatatgggtgtttgctggagcaccagaccgctgtccaccaacatgtcttttcattgcaggtattgctgagcttggggcatttttttccatcttgcaggacatgcggaatacaatcatggcatccaagacagttggaacctctgaggagaagctgcggaagaaatcttcattctatcagtcttatctcaggagaacacaatcaatgggaatacaactggatcagaggataattgtgctcttcatggtagcttgggggaaagaggcagtggataacttccacctaggagatgatatggatcctgagctgcgaacactagcacagagcctgattgatgttaaagtgaaggaaatttctaaccaagagcctttaaaattgtaa

SEQ ID NO: 2631 - RNA, 1290 nt, synthetic construct
  misc_feature 1..1290: note = derived and/or modified CDS sequence (wt) from HTNV(Aa10-434)__KT935038.1__N
  source 1..1290: mol_type = other RNA
atggcaactatggaggaattacagagggaaatcaatgcccatgagggtcaacttgtgatagccaggcagaaggtaagggatgcagaaaaacagtatggaaaggatccagatgagttgaacaagagagcattaacagaccgagagggtgttgcagtatctatccaggcaaagattgatgagttaaagagacagctggcagataggattgcaactgggaaaaaccttgggaaggaacaagatccaacaggggtagagcctggagaccatctgaaagagagatcaatgctcagttatggtaatgtgctggatttaaaccatttggatattgatgaacccacaggacagacagcagactggctaagcattgttgtctatcttacatcctttgttgtcccgatacttctgaaagctctatatatgttgacaacaagggggaggcaaactaccaaagataacaaaggaactcggattcgatttaaggatgatagctcgttcgaggacgttaacggtatccgaaaaccaaaacatctttatgtgtccttgccaaatgcacagtcaagtatgaaggcagaagagattacacctggtagatatagaacagcagtctgtggactctaccctgcacagatcaaggcacggcagatgatcagcccagtcatgagtgtgattggtttcctggcattggcaaaggattggagtgatcgtattgaacaatggttaagcgaaccttgcaagctccttccagatacagcagcagttagcctccttggtggtcctgcaacaaacagggactacttacggcagcggcaagtggcattaggcaatatggagacaaaagagtcaaaggctatacgccagcatgcagaagcagctggctgtagcatgattgaggacattgagtcaccatcatcaatatgggtatttgctggagcaccagaccgttgtccaccaacatgtttgtttatagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggatcattgtgctctttatggttgcttggggaaaggaggctgtggacaacttccacttaggggatgatatggatcctgagctaagaacacttgcacagagcttgattgatgtcaaagtgaaggaaatctccaaccaagagcctttaaaactctaa

SEQ ID NO: 2632 - RNA, 1290 nt, synthetic construct
  misc_feature 1..1290: note = derived and/or modified CDS sequence (wt) from HTNV(Aa14-362)__KT935049.1__N
  source 1..1290: mol_type = other RNA
atggcaactatggaagaattacagagggaaatcaatgcccatgagggtcaacttgtgatagccaggcagaaggtgagggatgcagaaaaacagtatgaaaaggatccagatgagttgaacaagagagcattaacagaccgagagggtgttgcagtatctatccaggcaaagattgatgagttaaagaggcagctggcagataggattgcaactgggaaaaaccttgggaaggaacaagatccaacaggggtagagcctggagaccatctgaaagagagatcaatgctcagttatggtaatgtgctggatttaaaccatttggatattgatgaacccacaggacagacagcagactggctaagcattgttgtctatcttacatcctttgtggtcccgatacttctgaaagctctatatatgttgacaacaagggggaggcaaactaccaaggataacaaaggaacccggattcgatttaaggatgatagctcattcgaggatgttaacggtatccgaaaaccaaaacatctttatgtgtccttgccaaatgcacagtcaagtatgaaggcagaagagattacacctggtagatatagaacagcagtctgtggactctaccctgcacagatcaaggcacggcagatgatcagcccagtcatgagtgtgattggttttctggcattggcaaaggattggagtgatcgtgttgaacaatggttaagcgaaccttgcaagctccttccagatacagcagcagttagcctccttggtggtcctgcaacaaacagggactacttacggcagcggcaagtggcattaggcaatatggagacaaaagagtcaaaggctatacgccagcatgcagaagcagctggctgtagcatgattgaggacattgagtcaccatcatcaatatgggtatttgctggagcaccagaccgttgtccaccaacatgtttgtttatagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggatcattgtgctctttatggttgcttggggaaaggaggctgtggacaacttccacttaggggatgatatggatcctgagctaagaacactggcacagagcttgattgatgtcaaagtgaaggaaatctccaaccaagaacctttaaaactctaa

SEQ ID NO: 2633 - RNA, 1290 nt, synthetic construct
  misc_feature 1..1290: note = derived and/or modified CDS sequence (wt) from HTNV(Aa14-404)__KT935052.1__N
  source 1..1290: mol_type = other RNA
atggcaactatggaggaattacagagggaaattaatgcccatgagggtcaattagtgatagccaggcagaaggtgagggatgcagaaaaacagtatgaaaaggatccagatgagttgaacaagagagcattgacggaccgagagggtgttgcagtatctatccaggcaaagattgatgagttaaaaaggcagctggcagataggattgcaactgggaaaaaccttgggaaggaacaagatccaacaggggtagagcctggagaccatctaaaagagagatcaatgctcagttatggtaatgtgctggatttaaaccatttggatattgatgaacccacaggacagacagcagactggctaagcattgttgtctatctcacatcctttgttgtcccgatacttctgaaagctctatatatgttgacaacaagggggaggcaaaccaccaaggataacaaaggaacccggattcgattcaaggatgatagctcgttcgaggatgttaacggtatccggaaaccaaaacatctttatgtgtccttgccaaatgcacagtcaagtatgaaggcagaagagattacacctggtagatatagaacagcagtctgtgggctctaccctgcacagattaaggcacggcagatgatcagcccagtcatgagtgtgattggttttcttgcattggcaaaggattggagcgatcgtattgaacaatggttaagcgaaccttgcaagctccttccagatacagcagcagtcagcctccttggtggtcctgcaacaaacagggactacttacggcagcgacaagtggcattaggcaatatggagacaaaggagtcaaaggctatacgccagcatgcagaagcagctggctgcagcatgattgaggacattgagtcaccatcatcaatatgggtatttgctggagcaccagaccgttgtccaccaacatgtttgtttatagcaggtattgctgagcttggggcatttttttccatcctgcaggacatgcgaaatacaatcatggcatctaagacagttgggacatctgaggagaagctgcgaaagaaatcatcattctatcagtcctacctcaggaggacacaatcaatggggatacaactggaccaaaggattattgtgctcttcatggttgcctggggaaaggaggctgtggacaacttccacttaggggatgacatggatcctgagctgagaacactggcacagagcttgattgatgtcaaagtgaaggaaatctccagccaagagcctttaaaactctaa

SEQ ID NO: 2634 - RNA, 1290 nt, synthetic construct
  misc_feature 1..1290: note = derived and/or modified CDS sequence (wt) from HTNV(Aa15-56)__KU207195.1__N
  source 1..1290: mol_type = other RNA
atggcaactatggaggaattacagagagaaatcaatgcccatgagggtcaactggtgatagctaggcagaaggtgagggatgcagaaaaacagtatgaaaaggatccagatgagttgaacaagagagcattaacagaccgagagggtgttgcagtatctatccaggcaaagattgatgagttaaagaggcaactggcagataggattgcaactgggaaaaaccttgggaaggaacaggatccaacaggggtagagcctggagaccatctgaaagagagatcaatgctcagttatggtaatgtgctggatttaaaccatttggatattgatgaacccacaggacagacagcagactggctaagcattgttgtctatcttacatcctttgttgtcccaatacttctgaaagctctatatatgttgacaacaagggggaggcaaactaccaaggataacaaaggaacccggattcgatttaaggatgatagctcgtttgaggacgtaaacggtatcagaaagccaaaacatctttatgtgtccttgccaaatgcacagtcaagtatgaaggcagaagagattacacctggtagatatagaacagcagtctgtgggctctaccctgcacagatcaaggcacggcaaatgatcagcccagtcatgagtgtgattggttttctagcattggcaaaggattggagtgatcgtattgagcaatggttaaatgaaccttgcaagctccttccagatacagcagcagttagccttcttggtggtcctgcaacaaacagggactacttacggcagcggcaagtggcattaggcaatatggaaacaaaggaatcaaaggctatccgccagcatgcagaagcagctggctgtagcatgattgaggacattgagtcaccatcatcaatatgggtatttgccggagcaccagaccgttgtccaccaacatgtttgtttatagcaggtattgctgagcttggggcatttttttccatcctgcaggacatgcgaaatacaatcatggcatctaagacagttgggacatctgaggagaagctgcgaaagaaatcatcattctatcagtcttacctcaggaggacacaatcaatggggatacaactggaccagaggatcattgtgctctttatggttgcctggggaaaggaggctgtggacaacttccacttaggagatgatatggatcctgagctaagaacactggcacagagcttgattgatgtcaaagtgaaggaaatctccaaccaagagcctttaaaactctaa

SEQ ID NO: 2635 - RNA, 1290 nt, synthetic construct
  misc_feature 1..1290: note = derived and/or modified CDS sequence (wt) from HTNV(AA1719)__AF427319.1__N
  source 1..1290: mol_type = other RNA
atggcaactatggaggaattgcagagggaaatcaatgcccacgagggtcaactggtgatagccaggcagaaggttagggatgcagaaaagcagtatgaaaaggatccagatgagctaaacaagagagcattgacagatcgagagggtgttgcagtatccatccaagcaaagattgatgaattaaagaggcaactggcagatcggatcgcaaccgggaagaatcttggaaaggaacaagacccaacaggggtagaacctggagatcatctgaaagagagatcaatgctcagttatggaaatgttcttgacttaaaccacctggatattgatgagccgacaggacagacagcagactggctgagcattgttgtctatcttacatcctttgttgtcccaatacttctgaaagctctgtatatgttaacaacaagggggaggcagaccaccaaggacaataagggaactcggattcgattcaaggatgatagttccttcgaggatgtcaatggcatccggaagccaaaacatctatatgtgtccttgccaaatgcacagtcaagtatgaaagcagaagagattacacctggtagatatagaacagcaatttgtgggctttatcctgcacaaattaaggcaagacagatgattagtcctgtcatgagtgtgatcggattcctggctctggcaaaagattggagtgaccgcattgagcagtggttaagtgaaccctgcaagcttcttccagacacagcagcagttagcctccttggtggtcctgctaccaacagggactacctacggcagcggcaagtggcattaggcaatatggaaacaaaagagtctaaggctatacgccaacatgcagaggcagcaggctgtagcataattgaggacattgagtcaccatcctcaatatgggtgtttgctggagcaccagaccgctgcccaccaacatgtcttttcattgcaggtattgctgagcttggggcatttttttccatcttgcaggatatgcggaatacaatcatggcatccaagacagttggaacctctgaggagaagctgcggaagaaatcttcattctatcagtcttatctcaggagaacacaatcaatgggaatacaactggatcagaggataattgtgctattcatggtagcttgggggaaagaggcagtggataacttccacctaggagatgatatggatcctgagctgcgaacactagcacagagcctgattgatgttaaagtgaaggaaatttctaaccaagagcctttaaaattgtaa

SEQ ID NO: 2636 - RNA, 1290 nt, synthetic construct
  misc_feature 1..1290: note = derived and/or modified CDS sequence (wt) from HTNV(AP1168)__AF427323.1__N
  source 1..1290: mol_type = other RNA
atggcaactatggaagaattgcaaaaggagatcaatgcccatgagggtcagcttgtgatagcaaggcaaaaagtaagggatgcagaaagacaatatgagaaggacccagatgaattaaataaaagagcattaacagacagggagggggttgcagcatccattcaggcaaaaattgacgaattgaagagacaattggcagataggattgcaactggaaaaaaccttggaaaagagcaagacccgacaggtgttgaacctggagaccatttaaaagaaagatcaatgcttagttatgggaatgtactggacttaaaccatctagacattgatgaaccaacaggacagactgcagattggctgagcattgttgtttaccttacatccttcgtggttccaatactcctgaaggccctttatatgctaacaacaaggggaagacagacaaccaaggataataaaggaacaagaattcgattcaaagatgacagctcctttgaggatgtgaatggaatccggaagccaaagcatctctatgtgtccttgcccaatgcacagtctagcatgaaagcagaagagataacacctggaagatacaggacggcaatctgtggattatatcctgctcagattaaagctagacagatggtcagccctgtcatgagtgtgatcggatttctggccttggctaaggattggggtgatagaattgagcagtggctgagtgaaccctgtaaactccttcctgacacagcagcagttagcctccatggtggtcctgcaactaatagagattatctccgacagaggcaggcagctttaggaaacatggaaaccaaagaatcaaaggcaattcgtcaacatgcagagacagctggctgtagcatgatagaagacattgaatcaccatcatcaatctgggtgtttgctggggcaccagaccgttgcccgccaacatgtctatttattgcaggaattgcagagcttggtgcctttttttccatcttgcaggatatgcggaatacaatcatggcatccaagacagtgggtacatctgaggaaaagctaagaaagaaatcatcattctaccaatcttatctcaggaggacacagtcaatgggaatacaactggaccaaagaataattgttctcttcatggttgcctggggaaaggaagcagtggacaatttccaccttggagatgatatggatcctgagttgagaacactagcacagagtctgattgatttgaaggtgaaggaaatttcaaaccaagaacctttaaaattataa

SEQ ID NO: 2637 - RNA, 1290 nt, synthetic construct
  misc_feature 1..1290: note = derived and/or modified CDS sequence (wt) from HTNV(AP708)__AF427322.1__N
  source 1..1290: mol_type = other RNA
atggcaactatggaagaattgcaaaaggagatcaatgcccatgagggtcagcttgtgatagcaaggcaaaaagtaagggatgcagaaagacaatatgagaaggacccagatgaattaaataaaagagcattaacagacagggagggggttgcagcatccattcaggcaaaaattgacgaattgaagagacaattggcagataggattgcaactggaaaaaaccttggaaaagagcaagacccgacaggtgttgaacctggagaccatttaaaagaaagatcaatgcttagttatgggaatgtactggacttaaaccatctagacattgatgaaccaacaggacagactgcagattggctgagcattgttgtttaccttacatccttcgtggttccaatactcctgaaggccctttatatgctaacaacaaggggaagacagacaaccaaggataataaaggaacaagaattcgattcaaagatgacagctcctttgaggatgtgaatggaatccggaagccaaagcatctctatgtgtccttgcccaatgcacagtctagcatgaaagcagaagagataacacctggaagatacaggacggcaatctgtggattatatcctgctcagattaaagctagacagatggtcagccctgtcatgagtgtgatcggatttctggccttggctaaggattggggtgatagaattgagcagtggctgagtgaaccctgtaaactccttcctgacacagcagcagttagcctccatggtggtcctgcaactaatagagattatctccgacagaggcaggcagctttaggaaacatggaaaccaaagaatcaaaggcaattcgtcaacatgcagagacagctggctgtagcatgatagaagacattgaatcaccatcatcagtctgggtgtttgctggggcaccagaccgttgcccgccaacatgtttatttattgcaggaattgcagagcttggtgcctttttttccatcttgcaggatatgcggaatacaatcatggcatccaagacagtgggtacatctgaggaaaagctaagaaagaaatcatcattctaccaatcttatctcaggaggacacagtcaatgggaatacaactggaccaaagaataattgttctcttcatggttgcctggggaaaggaagcagtggacaatttccaccttggagatgatatggatcctgagttgagaacactagcacagagtctgattgatttgaaggtgaaggaaatttcaaaccaagaacctttaaaattataa

SEQ ID NO: 2638 - RNA, 1290 nt, synthetic construct
  misc_feature 1..1290: note = derived and/or modified CDS sequence (wt) from HTNV(DandongHu-32)__KC570386.1__N
  source 1..1290: mol_type = other RNA
atggcaactatggaggaattgcagagggaaatcaatgcccacgagggtcaactggtgatagccaggcagaaggtgagggatgcagaaaagcagtatgaaaaggatccagatgagttaaacaagagagcattgacagatcgagagggtgttgcagtatccattcaagcaaagattgatgaattaaagaggcaattggcagataggattgcaaccgggaagaaccttggaaaggaacaagacccaacaggggtagaacctggagatcatctgaaagagagatcaatgctcagttatggaaatgttcttgacttaaaccacctggatattgatgagccaacaggacagacagcagactggctgagcattgttgtctatctcacatcctttgttgtcccgatacttctgaaagccctgtacatgttaacaacaagagggaggcagaccaccaaagacaataaaggaactcggattcgattcaaggatgatagctccttcgaggatgtcaatggcattcggaagccgaaacatctatacgtgtccttgccaaatgcacagtcaagtatgaaagcagaagagattacacctggtagatatagaacagcaatttgtggactttaccctgcacaaattaaggcaagacagatgattagtccagtcatgagtgtgatcggattcttggctttggcaaaagattggagtgaccgcattgagcagtggttaagtgaaccgtgtaagcttctcccagatacagcagcagttagccttcttggtggtcccgcaaccaacagggactatttacggcagcgacaagtagcattggggaacatggaaacaaaagagtctaaggctatacgccaacatgcagaagcagcaggctgtagtatgattgaggacattgagtcaccatcatcaatatgggtgtttgctggggcaccagaccgctgtccaccaacatgtctctttattgcaggtattgctgagcttggggcatttttttccatcctgcaggacatgcgaaatacaattatggcatccaagacagttggaacctctgaggagaagctacggaagaaatcctcattctatcagtcttatctcaggagaacacaatcaatgggaatacaactggatcagaggataattgtgctcttcatggtagcctgggggaaagaagcagtggataacttccacctaggagatgatatggaccctgagctgcgaatactagcacagagcctgattgatgttaaagtgaaggaaatttccaaccaagagcctttaaaactataa

SEQ ID NO: 2639 - RNA, 1290 nt, synthetic construct
  misc_feature 1..1290: note = derived and/or modified CDS sequence (wt) from HTNV(DandongHu-34)__KC570387.1__N
  source 1..1290: mol_type = other RNA
atggcaactatggaggaattgcagagggaaatcaatgcccacgagggtcaactggtgatagccaggcagaaggtgagggatgcagaaaagcagtatgaaaaggatccagatgagttaaacaagagagcattgacagatcgagagggtgttgcagtatccattcaagcaaagatcgatgaattaaagaggcaattggcagataggattgcaaccgggaagaaccttggaaaggaacaagacccaacaggggtagaacctggagatcatctgaaagagagatcaatgctcagttatggaaatgttcttgacttaaaccacctggatattgatgagccaacaggacagacagcagactggctgagcattgttgtctatctcacatcctttgttgtcccaatacttctgaaagccctgtacatgttaacaacaagagggaggcagaccaccaaggacaataaaggaactcggattcgattcaaggatgatagctccttcgaggatgtcaatggaattcggaagccgaaacatctatatgtgtccttaccaaatgcacagtcaagtatgaaagcagaagagattacacctggtagatatagaacagcaatttgtggactttaccctgcacaaattaaggcaagacagatgattagtccagtcatgagtgtaatcggattcttggctttggcaaaagattggagtgaccgcattgagcagtggttaagtgaaccgtgtaagcttcttccagatacagcagcagttagccttcttggtggtcctgcaaccaacagggactatttacggcagcgacaagtagcattgggcaacatggaaacaaaagagtctaaggctatacgccaacatgcagaagcagcaggctgtagtatgattgaggacattgagtcaccatcatcaatatgggtgtttgctggggcaccggaccgctgtccaccaacatgtctatttattgcaggtatggctgagcttggggcatttttttccatcctgcaggacatgcgaaatacaattatggcatccaagacagttggaacttctgaggagaagctacggaagaaatcctcattctatcagtcttatctcaggagaacacaatcaatgggaatacaactggatcagaggataattgtgctcttcatggtagcctgggggaaagaagcagtggataacttccacctaggagatgatatggatcctgagctgcgaacactagcacagagcctgattgatgttaaagtgaaggaaatttccaaccaagagcctttaaaactataa

SEQ ID NO: 2640 - RNA, 1290 nt, synthetic construct
  misc_feature 1..1290: note = derived and/or modified CDS sequence (wt) from HTNV(DandongHu-89)__KC570389.1__N
  source 1..1290: mol_type = other RNA
atggcaactatggaagaattgcagagggaaatcaatgcccacgagggtcaactggtgatagccaggcagaaggtgagggatgcagaaaagcagtatgaaaaggatccagatgagttaaacaagagagcattgacagatcgagagggtgttgcagtatccattcaagcaaagattgatgaattaaagaggcaattggcagataggattgcaaccgggaagaaccttggaaaggaacaagacccaacaggggtagaacctggagatcacctgaaagagagatcaatgctcagttatggaaatgttcttgacttaaaccacctggatattgatgagccaacaggacagacagcagactggctgagcattgttgtctatcttacatcctttgttgtcccaatacttctgaaagccctgtacatgttaacaacaagagggaggcagaccaccaaggacaataaaggaactcggattcgattcaaggatgatagctccttcgaggatgtcaatggcattcggaagccgaaacatctatgtgtgtccttaccaaatgcacagtcaagtatgaaagcagaagagattacacctggtagatatagaacagcaatttgtggactttaccctgcacaaattaaggcaagacagatgattagtccagtcatgagtgtaatcggattcttggctttggcaaaagattggagtgaccgcattgagcagtggttaagtgaaccatgtaagcttctcccagatacagcagcagttagccttcttggtggtcctgcaaccaacagggactatttacggcagcgacaagtagcattgggcaacatggaaacaaaagagtctaaggctatacgccaacatgcagaagcagcaggctgtagtatgattgaggacattgagtcaccatcatcaatatgggtgtttgctggggcaccagaccgctgtccaccaacatgtctctttattgcaggtattgctgagcttggggcatttttttccatcctgcaggacatgcgaaatacaattatggcatccaagacagttggaacctctgaggagaagctacggaagaaatcctcattctatcagtcttatctcaggagaacacaatcgatgggaatacaactggatcagaggataattgtgctcttcatggtagcctgggggaaagaagcagtggataacttccacctaggagatgatatggatcctgagctgcgaacactagcacagagcctgattgatgttaaagtgaaggaaatttccaaccaagagcctttaaaactataa

SEQ ID NO: 2641 - RNA, 1290 nt, synthetic construct
  misc_feature 1..1290: note = derived and/or modified CDS sequence (wt) from HTNV(DandongHu-91)__KC570390.1__N
  source 1..1290: mol_type = other RNA
atggcaactatggaggaattgcagagggaaatcaatgcccatgagggtcaactggtgatagccaggcagaaggtgagggatgcagaaaagcagtatgaaaaggatccagatgagttaaacaagagagcattgacagatcgagagggtgttgcagtatccattcaagcaaagattgatgagttaaagaggcaattggcagataggattgcaaccgggaagaaccttggaaaggaacaagacccaacaggggtagaacctggagatcatctgaaagagagatcaatgctcagttatggaaatgttcttgacttaaaccacctggatattgatgagccaacaggacagacagcagactggctgggcattgttatctatctcacatcctttgttgtcccgatacttctgaaagccctgtacatgttaacaacaagagggaggcagaccaccaaggacaataaaggaactcggattcgattcaaggatgatagctccttcgaggatgtcaatggcattcggaagccgaaacatctatatgtgtccttaccaaatgcacagtcaagtatgaaagcagaagagattacacctggtagatatagaacagcaatttgtggactttaccctgcacaaattaaggcaagacagatgattagtccagtcatgagtgtaatcggattcttggctttggcaaaagattggagtgaccgcattgagcagtggttaagtgaaccgtgtaagcttcttccagatacagcagcagttagccttcttggtggtcctgcaaccaacagggactatttacggcagcgacaagtagcattgggcaacatggaaacaaaagagtctaaggctatacgccaacatgcagaagcagcaggctgtagtatgattgaggacattgagtcaccatcatcaatatgggtgtttgctggggcaccggaccgctgtccaccaacatgtctctttattgcaggtatggctgagcttggggcatttttttccatcctgcaggacatgcgaaatacaattatggcatccaagacagttggaacctctgaggagaagctacggaagaaatcctcattctatcagtcttatctcaggagaacacaatcaatgggaatacaactggatcagaggataattgtgctcttcatggtagcctgggggaaagaagcagtggataacttccacctaggagatgatatggaccctgagctgcgaacactagcacagagcctgattgatgttaaagtgaaggaaatttccaaccaagagcctttaaaactataa

SEQ ID NO: 2642 - RNA, 1290 nt, synthetic construct
  misc_feature 1..1290: note = derived and/or modified CDS sequence (wt) from HTNV(Fuyuan-Aa-145)__KJ857349.1__N
  source 1..1290: mol_type = other RNA
atggcaactatggaggaattgcagagggaaatcaatgcccacgagggtcaactggtgatagccaggcagaaggttagggatgcagaaaagcagtatgaaaaagatccagatgagttaaacaaaagagcattgacagatcgagagggtgttgcagtatccatccaagcaaagattgatgaattaaagagacaactggcagatcggattgcaaccgggaagaatcttggaaaggaacaagacccaacaggagtagaacctggagatcatctgaaagagagatcaatgctcagttatggaaatgttcttgacttaaaccacctggatattgatgagccgacaggacagacagcagactggctgagcattgttgtctatcttacatcctttgttgtcccgatacttctgaaagccctgtatatgttaacaacaagggggaggcagaccaccaaggacaataaggggactcggatccgattcaaggatgatagttccttcgaggatgtcaatggcatccggaaaccaaaacatctatatgtgtccttgccaaatgctcagtcaagtatgaaagcagaagagattacacctggtagatatagaacagcaatttgtgggcttcatcctgcacaaattaaggcaagacagatgattagtcctgtcatgagtgtgatcggattcctggctttggcaaaagattggagtgaccgcattgagcagtggttaagtgaaccctgtaagctcctcccagacacagcagcagttagcctccttggtggtcctgctaccaacagggactacctacggcagcggcaagtggcattaggcaatatggaaacaaaagagtctaaggctatacgccaacatgcagaggcagcaggctgtagcatgattgaggacattgagtcaccatcctcaatatgggtgtttgctggagcacctgaccgctgtccaccaacatgtcttttcattgcaggtattgctgagcttggggcatttttttccatcttgcaggatatgcggaatacaatcatggcatccaagacagttggaacctctgaggaaaaactgcggaagaaatcttcattctatcagtcttatctcaggagaacacaatcaatgggaatacaactggatcagaggataattgtgcttttcatggtagcctgggggaaagaagcagtggataacttccacctaggagatgatatggatcctgagctgcgaacactagcgcagagcctgattgatgttaaagtgaaggaaatttccaaccaagagcctttaaaattataa

SEQ ID NO: 2643 - RNA, 1290 nt, synthetic construct
  misc_feature 1..1290: note = derived and/or modified CDS sequence (wt) from HTNV(Fuyuan-Aa-26)__KJ857347.1__N
  source 1..1290: mol_type = other RNA
atggcaactatggaggaattgcagagggaaatcaatgcccacgagggtcaactggtgatagccaggcagaaggttagggatgcagaaaagcagtatgaaaaagatccagatgagttaaacaagagagcattgacagaccgagagggtgttgcagtatccatccaagcaaagattgatgaattaaagagacaactggcagatcggattgcaaccgggaagaatcttggaaaggaacaagacccaacaggagtggaacctggagatcatctgaaagagagatcaatgctcagttatggaaatgttcttgacttaaaccacctggatattgatgagccgacaggacagacagcagactggctgagcattgttgtctatcttacatcctttgctgttccgatacttctgaaagccctgtatatgttaacaacaagggggaggcagaccaccaaggacaataaggggactcggattcgattcaaggatgatagttccctcgaggatgtcaatggcatccggaaaccaaaacatctatatgtgtccttgccaaatgctcaatcaagtatgaaagcagaagagattacacctggtagatatagaacagcaatttgtgggctttatcctgcacaaattaaggcaagacagatgattagtcctgtcatgagtgtgatcggattcctggctttggcaaaagattggagtgaccgcattgagcagtggttaagtgaaccctgtaagctcctcccagacacagcagcagttagcctccttggtggtcctgctaccaacagggactacctacggcagcggcaagtggcattaggcaatatggaaacaaaagagtctaaggctatacgccaacatgcagaggcagcaggctgtagcatgattgaggacattgagtcaccatcctcaatatgggtgtttgctggagcacctgaccgctgtccaccaacatgtcctttcattgcaggtatcgctgagcttggggcatttttttccatcttgcaggatatgcggaatacaatcatggcatccaagacagttggaacctctgaggagaaactgcggaagaaatcttcattctatcagtcttatctcaggagaacacaatcaatgggaatacaactggatcagaggataattgtgcttttcatggtagcctgggggaaagaagcagtggataacttccacctaggagatgatatggatcctgagctgcgaacactagcacagagcctgattgatgttaaagtgaaggaaatttccaaccaagagcctttaaaattataa

SEQ ID NO: 2644 - RNA, 1290 nt, synthetic construct
  misc_feature 1..1290: note = derived and/or modified CDS sequence (wt) from HTNV(JS1)__KP970572.1__N
  source 1..1290: mol_type = other RNA
atggcaactatggaggaattacagagggaaatcaatgcccatgagggtcaattagtgatagccaggcagaaggtgagggatgcagaaaaacagtatgaaaatgatccagatgagttgaacaagagagcattaactaaccgagagggcgttgcagtatctatccaggcaaaaattgatgagttaaaaaggcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaa

SEQ ID NO: 2645 - RNA, 1290 nt, synthetic construct
  misc_feature 1..1290: note = derived and/or modified CDS sequence (wt) from HTNV(LongquanAa-08-150)__JQ912697.1__N
  source 1..1290: mol_type = other RNA
atggcaactatggaagaactgcagagggagatcgatgcccatgagggccaactggtgatagccaggcagaaggtgagggatgcagaaaaacaatatgaaaaggatccagatgagttaaacaaaagagcattgacagacagagaaggggttgcagcatccatccaagccaagattgatgaattaaagaggcaactggcagataggattgcaactggaaagaaccttggaaaagaacaggatccaacaggggttgaacctggagaccatctaaaagagagatcaatgctcagttatgggaatgtattggatttgaaccacctggatattgatgagcctacaggacagactgcagactggctaagtattgttgtctacctaacatcctttgttgtgccaatacttctgaaagccctgtatatgctgactacaagagggagacagacaaccaaagataataaagggaccaggattcgattcaaggatgacagctcttttgaggatgtcaatgggattaggaagccaaaacatctgtatgtgtccttacccaatgcccagtcaagcatgaaggcagaagagatcacaccaggtagatacagaacagcaatttgtgggctctatcctgcacagattaaagccagacaaatgattagcccagtcatgagtgtgatcggtttcttggcactagcaaaagattgggctgaccggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgctggttgtagcatgattgaagatattgagtcaccatcgtcgatatgggtctttgctggagcaccagatcgctgtccaccaacatgtttattcattgcagggattgctgaacttggagcattcttttctatcctacaggacatgagaaatacaattatggcttcaaagacagtgggaacatctgaagaaaaattgcggaaaaaatcatcgttctatcaatcttatctcaggcgaacgcaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2646 - RNA, 1290 nt, synthetic construct
  misc_feature 1..1290: note = derived and/or modified CDS sequence (wt) from HTNV(LongquanAa-08-157)__JQ912698.1__N
  source 1..1290: mol_type = other RNA
atggcaactatggaagaactacagagggagatcaatgcccatgagggccaactggtgatagccaggcagaaggtgagggatgcagaaaaacaatatgaaaaggatccagatgagttaaacaaaagagcattgacagacagagaaggggttgcagcatccatccaagccaagattgatgaattaaagaggcaactggcagataggattgcaactggaaagaaccttgggaaagaacaggatccaacaggggttgaacctggagaccatctaaaagagagatcaatgctcagctatgggaatgtattggatttgaaccacctggatattgatgagcctacaggacagactgcagactggctaagtattgttgtctacctaacatcctttgttgtgccaatacttctgaaagccctgtatatgctgactacaagagggagacagacaaccaaagataataaagggaccaggattcgattcaaggatgacagctcttttgaggatgtcaatgggattaggaaaccaaaacatctgtatgtgtccttacccaatgcccagtcaagcatgaaggcagaagagatcacaccaggtagatacagaacagcaatttgtggactctatcctgcacagattaaagccagacaaatgattagcccagtcatgagtgtgatcggtttcttggcactggcaaaagattgggctgatcggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgcaggttgtagcatgattgaagatattgagtcaccatcgtcgatatgggtctttgctggagcaccagatcgctgtccaccaacatgcttattcattgcagggatcgctgaacttggagcattcttttctatcctacaggacatgagaaatacaattatggcttcaaagacagtgggaacatctgaagaaaaattgcggaaaaaatcatcgttctatcaatcttatctcaggcgaacacaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2647 - RNA, 1290 nt, synthetic construct
  misc_feature 1..1290: note = derived and/or modified CDS sequence (wt) from HTNV(LongquanAa-08-314)__JQ912709.1__N
  source 1..1290: mol_type = other RNA
atggcaactatggaagaactacagagggagatcaatgcccatgagggccaactggtgatagccaggcagaaggtgagggatgcagaaaaacaatatgaaaaggatccagatgagttaaacaaaagagcattgacagacagagaaggggttgcagcatccatgcaagccaagattgatgaattaaagaggcaactggcagataggattgcaactggaaagaaccttgggaaagaacaggatccaacaggggtggaacctggagaccatctaaaagagagatcaatgctcagctatgggaatgtattggatttgaaccacctggatattgatgagcctacaggacagactgcagactggctaagtattgttgtctacctaacatcctttgttgtgccaatacttctgaaagctctgtatatgctgactacaagagggagacagacaaccaaagataataaagggaccaggattcgattcaaggatgacagctcttttgaggatgtcaatgggattaggaaaccaaaacatctgtatgtgtccttacccaatgcccagtcaagcatgaaggcagaagagatcacaccaggtagatacagaacagcaatttgtggactctatcctgcacagattaaagccagacaaatgattagcccagtcatgagtgtgatcggtttcttggcactggcaaaagattgggctgatcggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgcaggttgtagcatgattgaagatattgagtcaccatcgtcgatatgggtctttgctggagcaccagatcgctgtccaccaacatgcttattcattgcagggatcgctgaacttggagcattcttttctatcctacaggacatgagaaatacaattatggcttcaaagacagtgggaacatctgaagaaaaattgcggaaaaaatcatcgttctatcaatcttatctcaggcgaacacaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2648 - RNA, 1290 nt, synthetic construct
  misc_feature 1..1290: note = derived and/or modified CDS sequence (wt) from HTNV(LongquanAa-08-573)__JQ912714.1__N
  source 1..1290: mol_type = other RNA
atggcaactatggaagaactacagagggagatcaatgcccatgagggccaactggtgatagccaggcagaaggtgagggatgcagaaaaacaatatgaaaaggatccagatgagttaaacaaaagagcattgacagacagagaaggggttgcagcatccatccaagccaagattgatgaattaaagaggcaactggcagataggattgcaactggaaagaaccttggaaaagaacaggatccaacaggggttgaacctggagaccatctaaaagagagatcaatgctcagctatgggaatgtattggatttgaaccacctggatattgatgagcctacaggacagactgctgactggctaagtattgttgtctacctaacatcctttgttgtgccaatacttctgaaagccctgtatatgctgactacaagagggagacagacaaccaaagataataaagggaccaggattcgattcaaggatgacagctcttttgaggatgtcaatgggattaggaagccaaaacatctgtatgtgtccttacccaatgcccagtcaagcatgaaggcagaagagatcacaccaggtagatacagaacagcaatttgtgggctctatcctgcacagattaaagccagacaaatgattagcccagtcatgagtgtgatcggtttcttggcactagcaaaagattgggctgaccggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgcgactgctggttgtagcatgattgaagatattgagtcaccatcgtcgatatgggtctttgctggagcaccagatcgctgtccaccaacatgcttattcattgcagggattgctgaacttggagcattcttttctatcctacaggacatgagaaatacaattatggcttcaaagacagtgggaacatctgaagaaaaattgcggaaaaaatcatcgttctatcaatcttatctcaggcgaacgcaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2649 - RNA, 1290 nt, synthetic construct
  misc_feature 1..1290: note = derived and/or modified CDS sequence (wt) from HTNV(LongquanAa-09-113)__JQ912716.1__N
  source 1..1290: mol_type = other RNA
atggcaactatggaagaactacagagggagatcaatgcccatgagggccaactggtgatagccaggcagaaggtgagggatgcagaaaaacaatatgaaaaggatccagatgagttaaacaaaagagcattgacagacagagaaggggttgcagcatccatccaagccaagattgatgaattaaagaggcaactggcagataggattgcaactggaaagaaccttgggaaagaacaggatccaacaggggttgaacctggagaccatctaaaagagagatcaatgctcagctatgggaatgtattggatttgaaccacctggatattgatgagcctacaggacagactgcagactggctaagtattgttgtctacctaacatcctttgttgtgccaatacttctgaaagccctgtatatgctgactacaagagggagacagacaaccaaagataataaagggaccaggattcgattcaaggatgacagctcttttgaggatgtcaatgggactaggaaaccaaaacatctgtatgtgtccttacccaatgcccagtcaagcatgaaggcagaagagatcacaccaggtagatacagaacagcaatttgtggactctatcctgcacagattaaagccagacaaatgattagcccagtcatgagtgtgatcggtttcttggcactggcaaaagattgggctgatcggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgcaggttgtagcatgattgaagatattgagtcaccatcgtcgatatgggtctttgctggagcaccagatcgctgtccaccaacatgcttattcattgcagggatcgctgaacttggagcattcttttctatcctacaggacatgagaaatacaattatggcttcaaagacagtgggaacatctgaagaaaaattgcggaaaaaatcatcgttctatcaatcttatctcaggcgaacacaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2650 - RNA, 1290 nt, synthetic construct
  misc_feature 1..1290: note = derived and/or modified CDS sequence (wt) from HTNV(LongquanAa-09-191)__JQ912719.1__N
  source 1..1290: mol_type = other RNA
atggcaactatggaagaactacagagggagatcaatgcccatgagggccaactggtgatagccaggcagaaggtgagggatgcagaaaaacaatatgaaaaggatccagatgagttaaacaaaagagcattgacagacagagaaggggttgcagcatccatccaagccaagattgatgaattaaagaggcaactggcagataggattgcaactggaaagaaccttgggaaagaacaggatccaacaggggttgaacctggagaccatctaaaagagagatcaatgctcagctatgggaatgtattggatttgaaccacctggatattgatgagcctacaggacagactgcagactggctaagtattgttgtctacctaacatcctttgttgtgccaatacttctgaaagccctgtatatgctgactacaagagggagacagacaatcaaagataataaagggaccaggattcgattcaaggatgacagctcttttgaggatgtcaatgggattaggaaaccaaaacatctgtatgtgtccttacccaatgcccagtcaagcatgaaggcagaagagatcacaccaggtagatacagaacagcaatttgtggactctatcctgcacagattaaagccagacaaatgattagcccagtcatgagtgtgatcggtttcttggcactggcaaaagattgggctgatcggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgcaggttgtagcatgattgaagatattgagtcaccatcgtcgatatgggtctttgctggagcaccagatcgctgtccaccaacatgcttattcattgcagggatcgctgaacttggagcattcttttctatcctacaggacatgagaaatacaattatggcttcaaagacagtgggaacatctgaagaaaaattgcggaaaaaatcatcgttctatcaatcttatctcaggcgaacacaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2651 - RNA, 1290 nt, synthetic construct
  misc_feature 1..1290: note = derived and/or modified CDS sequence (wt) from HTNV(LongquanAa-09-192)__JQ912720.1__N
  source 1..1290: mol_type = other RNA
atggcaactatggaagaactacagagggagatcaatgcccatgagggccaactggtgatagccaggcagaaggtgagggatgcagaaaaacaatatgaaaaggatccagatgagttaaacaaaagagcattgacagacagagaaggggttgcagcatccatgcaaggcaagattgatgaattaaagaggcaactggcagataggattgcaactggaaagaaccttgggaaagaacaggatccaacaggggtggaacctggagaccatctaaaagagagatcaatgctcagctatgggaatgtattggatttgaaccacctggatattgatgagcctacaggacagactgcagactggctaagtattgttgtctacctaacatcctttgttgtgccaatacttctgaaagctctgtatatgctgactacaagagggagacagacaaccaaagataataaagggaccaggattcgattcaaggatgacagctcttttgaggatgtcaatgggattaggaaaccaaaacatctgtatgtgtccttacccaatgcccagtcaagcatgaaggcagaagagatcacaccaggtagatacagaacagcaatttgtggactctatcctgcacagattaaagccagacaaatgattagcccagtcatgagtgtgatcggtttcttggcactggcaaaagattgggctgatcggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgctggttgtagcatgattgaagatattgagtcaccatcgtcgatatgggtctttgctggagcaccagatcgctgtccaccaacatgcttattcattgcagggattgctgaacttggagcattcttttctatcctacaggacatgagaaatacaattatggcttcaaagacagtgggaacatctgaagaaaaattgcggaaaaaatcatcgttctatcaatcttatctcaggcgaacgcaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2652 - RNA, 1290 nt, synthetic construct
  misc_feature 1..1290: note = derived and/or modified CDS sequence (wt) from HTNV(LongquanAa-10-46)__JQ912754.1__N
  source 1..1290: mol_type = other RNA
atggcaactatggaagaactacagagggagatcaatgcccatgagggccagctggtgatagccaggcagaaggtgagggatgcagaaaaacaatatgaaaaggatccagatgagttaaacaaaagagcattgacagacagagaaggggttgcagcatccatccaagccaagattgatgaattaaagaggcaactggcagataggattgcaactggaaagaaccttgggaaagaacaggatccaacaggggttgaacctggagaccatctaaaagagagatcaatgctcagctatgggaatgtattggatttgaaccacctggatattgatgagcctacaggacagactgcagactggctaagtattgttgtctacctaacatcctttgttgtgccaatacttctgaaagccctgtatatgctgactacaagagggagacagacaaccaaagataataaagggaccaggattcgattcaaggatgacagctcttttgaggatgtcaatgggattaggaaaccagaacatctgtatgtgtccttacccaatgcccagtcaagcatgaaggcagaagagatcacaccaggtagatacagaacagcaatttgtggactctatcctgcacagattaaagccagacaaatgattagcccagtcatgagtgtgatcggtttcttggcactggcaaaagattgggctgatcggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgcaggttgtagcatgattgaagatattgagtcaccatcatcgatatgggtctttgctggagcaccagatcgctgtccaccaacatgcttattcattgcagggatcgctgaacttggagcattcttttctatcctacaggacatgagaaatacaattatggcttcaaagacagtgggaacatctgaagaaaaattgcgaaaaaaatcatcgttctatcaatcttatctcaggcgaacacaatcaatggggattcaactggaccagaggatcattgtgctcttcatggttgcctggggtaaagaggcggtggacaatttccacctaggggatgatatggatcctgagctgagaacactggcacagagcctgattgatgttaaagtgaaggaaatatctaaccaagagcctttaaaactgtaa

SEQ ID NO: 2653 - RNA, 1290 nt, synthetic construct
  misc_feature 1..1290: note = derived and/or modified CDS sequence (wt) from HTNV(LongquanAa-11-745)__KC344237.1__N
  source 1..1290: mol_type = other RNA
atggcaactatggaagaactacagaaggagatcaatgcccatgagggtcaactggtgatagccaggcagaaggtgagggatgcagaaaaacaatatgaaaaggatccagatgagttaaacaaaagagcattgacagacagagaaggggttgcagcatccatccaagccaagattgatgaattaaagaggcaactggcagataggattgcaactggaaagaaccttgggaaagaacaggatccaacaggggttgaacctggagaccatctaaaagagagatcaatgctcagctatgggaatgtattggatttgaaccacctggatattgatgagcctacaggacagactgcagactggctaagtattgttgtctacctaacatcctttgttgtgccaatacttctgaaagccctgtatatgctgactacaagagggagacagacaaccaaagataataaagggaccaggattcgattcaaggatgacagctcttttgaggatgtcaatgggattaggaaaccaaaacatctgtatgtgtccttacccaatgcccagtcaagcatgaaggcagaagagatcacaccaggtagatacagaacagcaatttgtggactctatcctgcacagattaaagccagacaaatgattagcccagtcatgagtgtgatcggtttcttggcactggcaaaagattgggctgatcggattgagcaatggctaagtgaaccttgtaaactactcccagatacagcagcagtaagcctccatggaggccctgcaacaaacagggattacctacggcaacgacaggtggcattgggcaatatggagacaaaagagtcaaaggccatacgccaacatgctgagactgcaggttgtagcatgattgaagatattgagtcaccatcgtcgatatgggtctttgctggagcaccagatcgctgtccaccaacatgcttattcattgcagggatcgctgaacttggagcattcttttctatcctacaggacatgagaaatacaattatggcttcaaagacagtgggaacatctgaagaaaaattgcggaaaaaatcgtcgttctatcaatcttatctcaggcgaacacaatcaatggggattcaactggaccagaggatcattgtgcttttcatggttgcctggggtaaagaggcagtggacaatttccacctaggggatgatatggatcctgagctgagaacactggcacagagcctgattgatgttaaagtgaaggaaatatctaaccaagagcctttaaaactgtaa

SEQ ID NO: 2654 - RNA, 1290 nt, synthetic construct
  misc_feature 1..1290: note = derived and/or modified CDS sequence (wt) from HTNV(ROKA14-11)__KU207207.1__N
  source 1..1290: mol_type = other RNA
atggcaactatggaggaattacagagggaaatcaatgcccatgagggtcaacttgtgatagccaggcagaaggtaagggatgcagaaaaacagtatgaaaaggatccagatgagttgaacaagagagcattaacagaccgagagggtgttgcagtatctatccaggcaaagattgatgagttaaagaggcagctggcagataggattgcaactgggaaaaatcttgggaaggaacaagatccaacaggggtagagcctggagaccatctgaaagaaagatcaatgctcagttatggtaatgtgcttgatttaaaccatttggatattgatgaacccacaggacagacagcagactggctaagcattgttgtctatcttacatcctttgtcgtcccgatacttttgaaagctctctatatgttaacaacaagggggaggcaaactaccaaggataacaaaggaactcggattcgatttaaggatgatagctcgttcgaggacgttaatggtatccgaaaaccaaaacatctttatgtgtccttgccaaatgcacagtcaagtatgaaggcagaagagattacacctggtagatatagaacagcagtctgtggactctaccctgcacagatcaaggcacggcagatgatcagcccagtcatgagtgtgattggtttcctggcattggcaaaggattggagtgatcgtattgaacaatggttaagcgaaccttgcaagctccttccagatacagcagcagttagcctccttggtggtcctgcaacaaacagggactacttacggcagcggcaagtggcattaggcaatatggagacaaaagagtcaaaggctatacgccagcatgcagaagcagctggctgtagcatgattgaggacattgagtcaccatcatcaatatgggtatttgctggagcaccagaccgttgtccaccaacatgtttgtttgtagcaggtattgctgagcttggggcatttttttccatcctgcaggacatgcgaaatacaatcatggcatctaagacagttgggacatctgaggagaagatgcgaaagaaatcatcattctatcagtcttatctcagaaggacacaatcaatggggatacaactggaccaaaggatcattgtgctctttatggttgcttggggaaaggaggctgtagacaacttccacttaggggatgatatggatcctgagctaagaacactagcacagagcttgattgatgtcaaagtgaaggaaatctccaatcaagagcctttaaaactctaa

SEQ ID NO: 2655 - RNA, 1290 nt, synthetic construct
  misc_feature 1..1290: note = derived and/or modified CDS sequence (wt) from HTNV(US8A14-2)__KU207208.1__N
  source 1..1290: mol_type = other RNA
atggcaactatggaggaactacagagggaaatcaatgcccatgagggtcaacttgtgatagccaggcagaaggtaagggatgcagaaaaacaggatggaaaggatccagatgagttgaacaagagagcattaacagaccgagagggtgttgcagtatctatccaggcaaagattgatgagttaaagaggcagctggcagataggattgcaactgggaaaaaccttgggaaggaacaagatccaacaggggtagagcctggagaccatctgaaagagagatcaatgctcagttatggtaatgtgctggatttaaaccatttggatattgatgaacccacaggacagacagcagactggctaagcattgttgtctatcttacatcctttgttgtcccgatacttctgaaagctctatatatgttgacaacaagggggaggcaaactaccaaggataacaaaggaactcggattcgatttaaggatgatagctcgttcgaggacgttaacggtatccgaaaaccaaaacatctttatgtgtccttgccaaatgcacagtcaagtatgaaggcagaagagattacacctggtagatatagaacagcagtctgtgggctctaccctgcacagatcaaggcacggcagatgatcagcccagtcatgagtgtgattggttttctggcattggcaaaggattggagtgatcgtattgaacaatggttaagcgaaccttgcaagctccttccagatacagcagcagttagcctccttggtggtcctgcaacaaacagggactacttacggcagcggcaagtggcattaggcaatatggagacaaaagagtcaaaggctatacgccagcatgctgaagcagctggctgtagcatgattgaggacattgagtcaccatcatcaatatgggtatttgctggagcaccagaccgttgcccaccaacatgtttgtttatagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggatcattgtgctctttatggttgcttggggaaaggaggctgtggacaacttccacttaggggatgatatggatcctgagctaagaacactggcacagagtttgattgatgtcaaagtgaaggaaatctccaaccaagagcctttaaaactctaa

SEQ ID NO: 2656 - RNA, 1290 nt, synthetic construct
  misc_feature 1..1290: note = derived and/or modified CDS sequence (wt) from HTNV(US8A15-1)__KU207209.1__N
  source 1..1290: mol_type = other RNA
atggcaactatggaggaattacagagggaaatcaatgcccatgagggtcaacttgtgatagccaggcagaaggtaagggatgcagaaaaacagtatgaaaaggatccagatgagttgaacaagagagcattaacagaccgagagggtgttgcagtatctatccaggcaaagattgatgagttaaagaggcagctggcagataggattgcaactgggaaaaaccttgggaaggaacaagatccaacaggggtagagcctggagaccatctgaaagagagatcaatgctcagttatggtaatgtgctggatttaaaccatttggatattgatgaacccacaggacagacagcagactggctaagcattgttgtctatcttacatcctttgttgtcccgatacttctgaaagctctatatatgttgacaacaagggggaggcaaactaccaaggataacaaaggaactcggattcgatttaaggatgatagctcgttcgaggacgttaacggtatccgaaaaccaaaacatctttatgtgtccttgccaaatgcacagtcaagtatgaaggcagaagagattacacctggtagatatagaacagcagtctgtgggctctaccctgcacagatcaaagcacggcaaatgatcagcccagtcatgagtgtgattggttttctggcattggcaaaggattggagtgatcgtattgaacaatggttaagcgaaccttgcaagctccttccagatacagcagcagttagccttcttggtggtcctgcaacgaacagggactacttacggcagcggcaagtggcattaggtaatatggagacaaaggaatcaaaggccattcgccagcatgcagaagcagctggctgtagcatgattgaagacattgagtcaccatcatcaatatgggtatttgctggagcaccagaccgttgtccaccaacatgtttgtttatagcaggtattgctgagcttggggcatttttttccatcctgcaggacatgcgaaatacaatcatggcatctaagatagttgggacatctgaggagaagctgcgaaagaaatcatcattctatcagtcttacctcaggaggacacaatcaatggggatacaactggaccaaaggattattgtgctctttatggttgcctggggaaaggaggctgtggacaacttccacttaggggatgatatggatcctgagctgagaacactggcacagagcttgattgatgtcaaagtgaaggaaatctccaaccaagagcctttaaaactctaa

SEQ ID NO: 2657 - RNA, 1290 nt, synthetic construct
  misc_feature 1..1290: note = derived and/or modified CDS sequence (wt) from HTNV(YaluRiver13)__HQ611981.1__N
  source 1..1290: mol_type = other RNA
atggcaactatggaggaattgcagagggaaatcaatgcccacgagggtcaactggtgatagccaggcagaaggtaagggatgcagaaaagcagtatgaaaaagatccagatgagttaaacaagagagcattgacagatcgagaaggtgttgcagtatccattcaagcaaagattgatgaattaaagagacaattggcagacaggattgcaaccgggaagaatcttggaaaggaacaagacccaacaggggtagaacctggagaccatctgaaagagagatcaatgctcagttatggaaatgttcttgacctgaaccacctggatattgatgagccaacagggcagacagcagactggctgagcattgttgtctatcttacatcctttgttgtcccgatacttctgaaagctctgtatatgttaacaacaagaggggggcagaccaccaaggacaataaaggaacccggattcgattcaaggatgatagctcttttgaagatgtcaatggtatccggaagccgaaacatctatatgtgtccttaccaaatgcacagtcaagtatgaaagcagaagagattacacctggtagatatagaacagcaatttgtgggctttatcctgcacaaattaaggcaagacagatgattagtccagtcatgagtgtaattggattcctggctttggcaaaagattggagtgaccgcattgagcaatggttaagtgaaccgtgtaagcttcttccagatacagcagcagttagcctccttggtggtcctgcaaccaacagggactatctacggcagcgacaagtggcattgggcaacatggaaacaaaagagtctaaagctatacgccagcatgcagaggcagcaggctgtagcatgattgaggacattgagtcaccatcatcaatatgggtgtttgctggggcaccagaccgctgcccaccaacatgtctttttattgcaagtattggagagcttggggcatttttttccatcttgcaggacatgcggaatacaatcatggcatccaagacagttggaacctctgaggagaagctacggaagaaatcttcattctatcagtcttatctcaggagaacacaatcaatgggaatacaactggatcagaggataattgtgctcttcatggtatcctggggaaaagaggcagtggataatttccacctaggagatgatatggatcctgagctgcgaacactagcacagagcctgattgatgttaaagtgaaggaaattcccaaccaagagcctttaaaactataa

SEQ ID NO: 2658 - RNA, 1290 nt, synthetic construct
  misc_feature 1..1290: note = derived and/or modified CDS sequence (wt) from HTNV(84FLi)__AY017064.1__N
  source 1..1290: mol_type = other RNA
atggcaactatggaggaactgcagagggaaatcaatgcccatgagggtcaactggtgatagccaggcagaaggtgagggatgcagaaaaacaatatgaaaaggatccagatgagctgaataaaagaacattaacagacagagaaggggttgcagcatctatccaggccaagattgatgaattgaaaaggcagttagcagataggattgcaaccggaaagaaccttgggaaagaacaggatcccacaggggttgagcctggagaccatctgaaagagagatcaatgcttagttatggaaatgtattggatttgaactacctggatattgatgagcctactggacagactgcagattggctcagtattgttatatatttaacatcctttgttgtcccaatacttctaaaggccctatatatgcttacaacaagagggaggcagacaaccaaagataataaagggactaggattcgattcaaggatgacagctcctttgaggatgttaacgggattcggaaaccaaaacatttatatgtttccttgcccaatgcccagtcaagcatgaaggcagaagagatcacaccagggagatacaggacagcaatctgtggactctaccctgcacagattaaggctagacagatgatcagccctgtcatgagtgttattggatttttggctctggcaaaagattggagtgaccgtattgagcagtggctaagtgaaccttgtaagctactcccagatacagcagcagtaagtctccacgggggccctgcaacaaacagggattacctacggcagcgccaagtggcattgggcaatatggaaacaaaagagtcaaaggctatacgtcaacatgctgaatctgcaggttgtagcatgattgaggacattgaatcaccatcatcgatatgggtgtttgctggagcaccagaccgctgtccgccaacatgcttatttattgcagggattgctgaacttggagcattcttttcaatcttacaggacatgcggaataccattatggcatcaaagacagtaggaacatctgaagagaaattacggaaaaaatcatcattctatcagtcttatctcaggcgaacacaatcaatgggaatacaactggaccagaggattatagtgctattcatggttgcctggggtaaagaggcagtggataacttccaccttggagatgacatggatcctgagttgagaacattggcacaaagcttgattgatgttaaagtgaaggaaatctccaaccaagagcctttaaaactataa

SEQ ID NO: 2659 - RNA, 1290 nt, synthetic construct
  misc_feature 1..1290: note = derived and/or modified CDS sequence (wt) from HTNV(Bao14)__AB127998.1__N
  source 1..1290: mol_type = other RNA
atggcaactatggaggaattgcagagggaaatcaatgcccacgagggtcaactggtgatagccaggcagaaggtgagggatgcagaaaagcagtatgaaaaggatccagatgagttaaacaagagaacattaacagatcgagagggtgttgcagtatccatccaagcaaagattgatgaattgaagaggcaactggcagatcggattgcaaccggaaagaatcttggaaaggagcaagacccaacaggggtagaacctggagatcatctgaaagagagatcaatgctcagttatggaaatgttcttgacttaaaccacctggatattgatgagccgacaggacagacagcagactggctgagcattgttgtctatcttacatcctttgttgtcccgatacttctgaaagctctgtatatgttaacaacaagggggaggcagaccaccaaggacaataagggaactcggattcgattcaaggatgatagttccttcgaggatgtcaatggcatccggaagccaaaacatctatatgtgtccttgccaaatgcacagtcaagtatgaaagcagaagagattacacctggtagatatagaacagcaatttgtggactttatcctgcacaaattaaggcaagacagatgattagtcctgtcatgagtgtgatcggattcctggctttggcaaaagattggagtgaccgcattgagcagtggttaagtgaaccctgtaagcttcttccagacacagcagcagttagcctcctcggtggtcctgctaccaacagggactacctacggcagcggcaagtagcattaggcaatatggaaacaaaagagtctaaggctatacgccaacatgcagaggcagcaggctgtagcatgattgaggacattgagtcaccatcctcaatatgggtgtttgctggagcaccagatcgctgtccaccaacatgtcttttcattgcaggtattgctgagcttggggcattcttttccatcttgcaggacatgcggaatacaatcatggcatccaagacagttggaacctctgaggagaagctgcggaagaaatcttcattctatcagtcttatctcaggagaacacaatcaatgggaatacaactggatcagaggataattgtgctcttcatggtagcctgggggaaagaagcagtggataacttccacctaggagatgatatggatcctgagctgcgaacactagcacagagcctgattgatgttaaagtgaaggaaatttccaaccaagagcctttaaaattataa

SEQ ID NO: 2660 - RNA, 1290 nt, synthetic construct
  misc_feature 1..1290: note = derived and/or modified CDS sequence (wt) from HTNV(Chen4)__AB027101.1__N
  source 1..1290: mol_type = other RNA
atggcaactatggaggaactgcagagggaaatcaatgcccatgagggtcaactggtgatagccaggcagaaggtgagggatgcagaaaaacaatatgaaaaggatccagatgagctgaataaaagaacattaacagacagagaaggggttgcagcatctatccaggccaagattgatgaattgaaaaggcagttagcagataggattgcaaccggaaagaaccttgggaaagaacaggatcccacaggggttgagcctggagaccatctgaaagagagatcaatgcttagttatggaaatgtattggatttgaaccacctggatattgatgagcctactggacagactgcagattggctcagtattgttatatatttaacatcctttgttgtcccaatacttctaaaggccctatatatgcttacaacaagagggaggcagacaaccaaagataataaagggactaggattcgattcaaggatgacagctcctttgaggatgttaacgggattcggaaaccaaaacatttatatgtttccttgcccaatgcccagtcaagcatgaaggcagaagagatcacaccagggagatacaggacagcaatctgtggactttaccctgcacagattaaggctagacagatgatcagccctgtcatgagtgttattggatttttggctctggcaaaagattggagtgaccgtattgagcagtggctaagtgcaccttgtaagctactcccagatacagcagcagtaagtctccacgggggccctgcaacaaacagggataacctacggcagcgccaagtggcattgggcaatatggaaacaaaagagtcaaaggctatacgtcaacatgctgaatctgcaggttgtagcatgattgaggacattgaatcaccatcatcgatatgggtgtttgctggagcaccagaccgctgtccgccaacatgcttatttattgcagggattgctgaacttggagcattcttttcaatcttacaggacatgcggaataccattatggcatcaaagacagtaggaacatctgaagagaaattacggaaaaaatcatcattctatcagtcttatctcaggcgaacacaatcaatgggaatacaactggaccagaggattatagtgctattcatggttgcctggggtaaagaggcagtggataacttccggcttggagatgacatggatcctgagttgagaacattggcacaaagcttgattgatgttaaagtgaaggaaatctccaaccaagagcctttaaaactataa

SEQ ID NO: 2661 - RNA, 1290 nt, synthetic construct
  misc_feature 1..1290: note = derived and/or modified CDS sequence (wt) from HTNV(Hu)__AB027111.1__N
  source 1..1290: mol_type = other RNA
atggcaactatggaagaactacagagggaaatcaatgcccatgagggccagctggtgatagccaggcagaaggtgagggatgcagaaaaacagtatgaaaaggatccagatgaactgaacaaaagagcattaacagacagagaaggggttgcagcatctatccaggctaagattgatgaattgaaaagacagttggcagataggattgcaactggaaagaaccttggaaaggaacaggacccaactggggttgaacctggagaccatcttaaggagagatcaatgcttagctatggcaatgtactggatttaaaccatttggatattgatgagcctacagggcagacagcagactggctaagtattgtcatatatctaacatcatttgttgtcccgatccttctaaaggccttgtatatgttaacaacaagagggagacaaacaaccaaagacaataagggaactagaattcggttcaaggatgatagctcttttgaggatgtcaatggaattcggaaaccaaagcatttatatgtgtccttacctaatgcccaatccagcatgaaggcagaagaaataacacctggtaggtatagaacagcaatttgtggactctaccctgcacagatcaaagcgagacaaatgattagccctgtcatgagtgtaatcggattcttggcactggcaaaggactggagtgaccgcattgaacagtggcttagtgaaccttgtaaactcctcccggacacagcagcagtaagtcttcatggaggtcctgcaacaaacagggactatctccggcagcggcaggtagcactgggcaatatggaaacgaaggagtcaaaggccatacgtcaacatgctgaagctgcaggctgtagcatgattgaagatattgagtcaccttcgtcaatatgggtctttgcaggggcccctgatcgcagcccaccgacatgcatgttcattgcagggattgatgaacttggggcatttttttccatcctacaggacatgaggaatacaattatggcttcaaagacagtgggaacatctgaagaaaaattgagaaaaaaatcatcattctaccagtcttatctcaggcgaacacaatcaatgggaatacaactggaccaaaggattatagtgctctttatggttgcctggggtaaagaggcagtcgataatttccaccttggagatgatatggatcctgagttgagaacactggcacagagtttgattgatattaaagtgaaggagatctccaaccaagagcctttaaaactataa

SEQ ID NO: 2662 - RNA, 1290 nt, synthetic construct
  misc_feature 1..1290: note = derived and/or modified CDS sequence (wt) from HTNV(HubeiHu02)__JQ665905.1__N
  source 1..1290: mol_type = other RNA
atggcaactatggaggaactgcagaaggaaatcaatgcccatgagggccaattggtaatagccaggcagaaggtgagggatgcagaaaaacagtatgagaaggacccagatgagctgaataagagaacattaacagacagagaaggggttgcagcatctatccaggccaaaattgatgaattaaagaggcagctagcagataggattgcaactggaaagaaccttggaaaggaacaggatcccaccggggttgagcctggagaccatctgaaagagagatcaatgctcagctatggaaatgtcctggatctgaaccacctggatattgatgaacctactggacagaccgcagattggctcagcattgtcatatatctaacatcctttgttgtcccaatacttctgaaagccctatacatgctgacaacaagagggaggcaaacaaccaaggataataaagggaccagaattcgattcaaggatgacagctcttttgaggatgttaatgggattcggaagccaaagcatttatatgtgtccttgcccaatgcccagtcaagcatgaaggcagaagacatcacaccaggaaggtataggacagcaatctgtggactctaccctgcacagattaaggccagacaaatgattagtcctgtcatgagtgtgattgggtttttggcacttgcaaaggactggagtgatcgtatcgagcaatggttgagtgaaccctgtaagctgctcccggatacagcagcagtgagcctccatggaggccctgcaacaaatagggactatttacggcagcgccaagtagcactgggtaatatggaaacaaaagagtcaaaagccatacgccagcatgctgaatctgcaggctgtagcatgattgaagatatcgagtcaccatcatcgatatgggtttttgctggagcacctgaccgttgcccaccaacatgcttattcattgcagggattgctgaacttggagcattcttctctatcctgcaggacatgcggaatacaattatggcctcaaagacagtgggaacatctgaagaaaagttacgaaagaaatcatcattctatcagtcttatctcaggcgaacacagtcgatgggaatacaactagaccagagaattatagtgctctttatggtcgcctggggtaaagaggcagtagacaatttccaccttggagatgatatggatcctgagttaagaacattggcacagagtttgattgatgttaaagtgaaggaaatctctaaccaagagcctttaaaactttaa

SEQ ID NO: 2663 - RNA, 1290 nt, synthetic construct
  misc_feature 1..1290: note = derived and/or modified CDS sequence (wt) from HTNV(HV004)__JQ083395.1__N
  source 1..1290: mol_type = other RNA
atggcaactatggaggaactgcagaaggaaatcaatgcccatgagggccaattggtaatagccaggcagaaggtgagggatgcagaaaagcagtatgagaaggacccagatgagctgaataagagagcattaacagacagagaaggggttgcagcatctatccaggccaaaattgatgaattaaagaggcagctagcagataggattgcaactggaaagaaccttggaaaggaacaagatcccaccggggttgaacctggagaccatctgaaagagagatcaatgcttagctatggaaatgtcctggatctgaaccacctggatattgatgaacctactggacagactgcagattggcttagcattgtcatatatctaacatcctttgttgtcccaatacttctgaaggccctatatatgttgacaacaagagggaggcaaacaaccaaggataataaagggacccgtattcggttcaaggatgacagctcttttgaggatgttaatgggattcggaagccgaagcatttatatgtgtccttgcccaatgcccagtcaagcatgaaggcagaagaaatcacaccagggaggtatagaacagcaatttgtggactctaccctgcacagattaaggccagacaaatgattagtcctgtcatgagtgtgattgggtttttggcacttgcaaaggactggagtgatcgtatcgagcaatggttaagtgaaccctgtaagctgctcccagatacagcagcagtgagcctccacggaggccctgcaacaaatagggactatttacggcagcgccaagtagcactgggtaatatggaaacaaaagagtcaaaagctatacgccagcatgctgaatctgcaggctgtagcatgattgaagatatcgagtcaccatcatcgatatgggtttttgctggagcacctgaccgttgcccaccaacatgcttattcattgcagggattgctgaacttggagcattcttttctatccttcaggacatgcggaatacaattatggcctcaaagacagtgggaacatctgaagaaaagttgcgaaagaaatcatcgttctatcagtcttatctcaggcgaacacagtcgatggggatacaactagaccagagaatcatagtgctctttatggtcgcctggggtaaagaggcggtagacaatttccaccttggagatgatatggatcctgagttaagaacactggcacagagtttgattgatgttaaagtgaaggaaatctctaatcaagagcctttaaaactttaa

SEQ ID NO: 2664 - RNA, 1290 nt, synthetic construct
  misc_feature 1..1290: note = derived and/or modified CDS sequence (wt) from HTNV(Maaji-1)__AF321094.1__N
  source 1..1290: mol_type = other RNA
atggcaactatggaggaattgcaaaaggagatcaatgcccacgagggtcagctggtgatagcacggcagaaggtgagagatgcagaaagacagtatgaaaaagacccagatgaattgaataaaagaacattaacagatagagagggggttgcagcatccatccaggccaaaattgatgagcttaaaaggcagctagcagatagaattgcaactggcaagaaccttggtaaagagcaagacccaacaggagtcgagccaggggaccatcttaaagaaagatcgatgctgagttatggaaatgttctggacttgaatcatctagacattgatgaacctactggacaaacagcagattggctcagcattgttatctacctgacatcgtttgtggtcccaattcttttaaaggctctatacatgctaacaacacgaggaagacagactactaaagacaacaaagggaccagaatcagatttaaggacgatagttcatttgaggatgtcaacgggattcgcaagcccaaacatctttatgtctcactgcctaatgcacaatccagtatgaaagcagaggagattacacctggcagatacagaacagctgtttgtggactttatcctgcccagatcaaagcacgacagatgatcagcccagtaatgagtgtgataggattcatggcacttgctaaagattggagtgaacggattgagcaatggttaagtgaaccctgtaagcttcttcctgacacatcagcagttagcctccttggtggccctgcaacaaacaaggactaccttcggcagagacaggttgctttaggcaatatggaaaccaaagagtcaaaggcaatacgacagcaggctgaggcttcaggctgcagcatgattgaagatattgaatcaccatcatcaatttgggtgtttgctggggcaccagatcggtgcccaccaacatgtctctttattgcagggatggcagagcttggggcattcttttctatcctgcaggacatgcgcaatacaatcatggcatcaaaaaccgttgggacatctgaggagaagctgagaaaaaaatcatcgttctaccaatcatatctcaggcggacacaatcaatggggatacaactggatcagaggattattgtcttatttatggtggcctggggaaaggaagctgttgataatttccatcttggtgatgatatggatcctgaacttaggacacttgctcagagtttgattgacgttaaagtgaaggaaatttccaaccaggagccactgaaactgtaa

SEQ ID NO: 2665 - RNA, 1290 nt, synthetic construct
  misc_feature 1..1290: note = derived and/or modified CDS sequence (wt) from HTNV(Maaji-2)__AF321095.1__N
  source 1..1290: mol_type = other RNA
atggcaactatggaggaattacagagggaaatcaatgcccatgagggtcaattagtgatagccaggcagaaggtgagggatgcagaaaaacagtatgaaaaggatccagatgagttgaacaagagaacattaactgaccgagagggtgttgcagtatctatccaggcaaagattgatgagttaaaaaggcaactggcagataggattgcaactgggaagaactttggaaaagaacaagatccaacaggggtagagcctggagaccatctgaaagagagatcaatgctcagttatggtaatgtgttggatttaaaccatttggatattgatgaacccacaggacagacagcagactggctaagcattgttgtctatctgacatcctttgttgtcccgatacttctgaaagctctatatatgttgacaacaagggggaggcaaactaccaaggataataaaggaacccggattcgatttaaggatgatagctcgttcgaggatgttaatggtatccgaaaaccaaaacatctgtatgtgtccttgccaaatgcacagtcaagtatgaaggcagaagagattacacctggtagatatagaacagcagtctgtggactctaccctgcacagatcaaggcacggcagatgatcagcccagtcatgagtgtaattggttttttggcattggcaaaagattggagtgatcgtattgaacaatggttaagcgaaccttgcaagctccttccagatacagcagcagtcagcctccttggtggtcctgcaacaaacagggactacttacggcagcggcaagtggcattaggtaatatggagacaaaggagtcaaaggctatacgccagcatgcagaagcagctggctgtagcatgattgaagacattgagtcaccatcatcaatatgggtatttgctggggcaccagaccgctgtccgccaacatgtttgtttatagcaggtattgctgagcttggagcatttttctccatcctgcaggacatgcgaaatacaatcatggcatctaagacagttggaacatctgaggagaagctgcgaaagaaatcatcattctatcagtcttacctcaggaggacacaattaatggggatacaactggatcaaaggattattgtgctctttatggttgcttgggggaaggaagctgtggacaacttccacttaggagatgacatggatcctgagctaagaacactggcacagagcttgattgatgtcaaagtgaaggaaatttccaaccaagagcctttaaaactctaa

SEQ ID NO: 2666 - RNA, 1290 nt, synthetic construct
  misc_feature 1..1290: note = derived and/or modified CDS sequence (wt) from HTNV(N8)__DQ658415.1__N
  source 1..1290: mol_type = other RNA
atggcaactatggaggaattacagagggaaatcaatgcccatgagggccagttagtgatagccaggcaaaaggtaagagatgcagaaaagcaatatgaaaaagacccagatgagctgaacaaaagaacattgacagacagggagggagttgcagcatccatccaggcaaagattgatgagcttaagcgacaactagcagacagaattgcaacagggaaaaatcttggcaaggagcaagacccgacaggagttgagcccggagaccacctaaaagagagatcaatgctcagctatggaaatgtcttggatctaaaccatctggatattgatgagccaacaggacagactgcagattggttgagcattgtcatctatttgacatcatttgttgttccaatactcctgaaagccctgtacatgttaacaacaagaggaaggcaaaccaccaaggacaacaaagggaccagaattcggttcaaggatgatagctcatttgaggatgttaatggtatccgaaagccaaaacatctgtatttatctctacccaatgcacagtcaagcatgaaggcagaagagattacacctggtaggtaccggacagcaatctgtggtctctatcctgcacaaattaaggcaaggcaaatgatcagtccagtcatgagtgtgattggatttttagcactggctaaggattggagtgaccgtattgagcagtggctaagtgagccttgcaaactcctcccagatgcagctgcagtcagccttcatggtggtcctgcaacaaatagagactacttacggcaacgtcaggtagcattaggcaatatggagacaaaagaatcaaaagccatccgccaacatgcagaaactgcaggttgtagcatgattgacgatattgagtcaccatcatcgatatgggtatttgctggggcacctgaccgttgtccacctacatgtctgtttatagcaggaatcgcagagcttggagcattcttctctatattgcaggacatgaggaacacaattatggcatctaaaacagtgggaacatctgaggaaaagttaagaaagaagtcttcattctaccagtcttatctcaggagaacacagtcaatgggaatacagctagatcagagaataattgtgctctttatggttgcatggggaaaagaagcagttgataatttccatctcggagatgatatggatcctgagctaagaacactagcacagagcctgattgatgtgaaagtgaaggagatctctaaccaagagcctttaaaactataa

SEQ ID NO: 2667 - RNA, 1290 nt, synthetic construct
  misc_feature 1..1290: note = derived and/or modified CDS sequence (wt) from HTNV(Q32)__AB027097.1__N
  source 1..1290: mol_type = other RNA
atggcaactatggaggaattgcagagggaaatcaatgcccatgagggccaactggtgatagccaggctcaaggtgagggatgcagaaaaaccctatgagaaggatccagatgaactgaacatgagaacattaactgacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactttatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcatagtgctctttatggttgcctggggtaaagaggctgtggataacttccagccaggggacgatatggaccctgaattaaggacactagcacaaagcctgattgatgttaaagtgaaggaaatttctaaccaagaaccattaaagctataa

SEQ ID NO: 2668 - RNA, 1290 nt, synthetic construct
  misc_feature 1..1290: note = derived and/or modified CDS sequence (wt) from HTNV(SXHu2012B1)__KC844226.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagagcattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggcattatatatgctcacaacaagagggaggcagacaaccaaagataacaaagggaccaggattcgattcaaggatgacagctcttttgaggatgttaacgggattcgaaagccaaagcatctatatgtgtccttacccaatgcccaatcaagcatgaaggcagaagagatcacaccaggtaggtacagaacagcaatctgtggactctaccctgcacagatcaaagccagacaaatgattagccctgtcatgagtgtaatcggatttttggcgctggcaaaagattggagtgaccgtatcgaacagtggttaagtgaaccttgtaagctactcccggacacagcagcagtaagccttcatggtggccctgcaacaaacagggattacctacggcagcgccaggtggcactgggtaatatggaaacaaaagaatcaaaggccatacgtcaacatgctgaatctgcaggctgcagcatggttgaggatattgagtcaccatcatcgatatgggtttttgccggagcaccagaccgctgtccaccgacatgcttgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcattgtgctctttatggttgcctggggtaaagaggctgtggataatttccaccttggagatgatatggatcctgagctaagaacattggcacaaagcctgattgatgtaaaagtgaaggaaatctctaaccaggagcctttaaaactataa

SEQ ID NO: 2669 - RNA, 1290 nt, synthetic construct
  misc_feature 1..1290: note = derived and/or modified CDS sequence (wt) from HTNV(TJJ16)__AY839871.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagagcattaacagacagggaagggcttgcagcatcaatccaggccaagattgatgaactgaaaaggcagctagcggataggattgcaactggaaaaaaccttggaaaggaacgggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtatattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcatagtgctctttatggttgcctggggtaaagaagctgtggataatttccaccttggagatgatatggatcctgagctaaggacattggcacaaagcctgattgatgtaaaagtgaaggaaatctctaaccaagagcctttaaaactataa

SEQ ID NO: 2670 - RNA, 1290 nt, synthetic construct
  misc_feature 1..1290: note = derived and/or modified CDS sequence (wt) from HTNV(WCL)__KM355414.1__N
  source 1..1290: mol_type = other RNA
atggcaactatggaggaattgcagagggaaatcaatgcccacgagggtcaactggtgatagccaggcagaaggtgagggatgcagaaaagcagtatgaaaaggatccagatgagttaaacaagagagcattgacagatcgagagggtgttgcagtatccatccaagcaaagattgatgaattagagaggcaactggcagatcggattgcaaccggaaaaaatcttggaaaggaacaagacccaacaggggtagaacctggagatcatctgaaagagagatcaatgctcagttatggaaatgttcttgatttaaaccacctggatattgatgagccgacaggacagacagcagactggctgagcattgttgtctatcttacatcctttgttgtcccgatacttctgaaagctctgtatatgttaacaacaagggggaggcagactaccaaggacaataagggaactcggattcgattcaaggatgatagttccttcgaggatgtcaatggcatccggaagccaaaacatctatatgtatccttgccaaatgcacagtcgagtatgaaagcagaggagattacacctggtagatacagaacagcaatttgtgggctttatcctgcacaaattaaggcaagacagatgattagtcctgtcatgagtgtgattggattcctggctttggcaaaagattggagtgaccgcattgagcagtggttaagtgaaccctgtaaacttcttccagacacagcagcagttagcctccttggtggtcccgctaccaacagggactacctacggcagcggcaagtggcattaggcaatatggaaacaaaagagtctaaggctatacgccaacatgcagaggcagcaggatgtagcatgattgaggacattgagtcaccatcctcaatatgggtatttgctggagcaccagaccgctgtccaccaacatgtcttttcattgcaggtattgctgagcttggggcatttttttccatcttgcaggacatgcggaatacaatcatggcatccaagactgtcggaacctctgaggagaagctgcggaagaaatcttcattctatcagtcttatctcaggagaacacaatcaatgggaatacaactggatcagaggataattgtgctcttcatggtagcctggggaaaagaagcagtggataacttccacctaggagatgatatggatcctgagctgcgaacactggcacagagcctgattgatgttaaagtgaaggaaatttccaaccaagagcctttaaaattataa

SEQ ID NO: 2671 - RNA, 1290 nt, synthetic construct
  misc_feature 1..1290: note = derived and/or modified CDS sequence (wt) from HTNV(YN509)__GU329991.1__N
  source 1..1290: mol_type = other RNA
atggcaacaatggaggagttacagaaggaaatcaatgcccatgagggccaactcataattgcaaagcagaaggtgaaagatgcagaaaagcaatatgagaaggacccagatgagttaaataagagggcgctgactgacagggaaggagttgcagcatccatccaggctaagatcgatgagctcaaaaggcagctagcagataggattgctacaggaaaaaatctgggtcaggatcgggatccaacaggtgtggagccaggggatcacctaaaagagagatcaatgctcagctatgggaacattcttgacttgaaccatcttgatattgatgagccaacagggcagactgcagactggctaagtatcattgtatatctaacatcgtttgtggttcctatcctgttaaaggcactgtacatgttaacaacaagggggaggcagactgcaaaggacaataaggggacacggattcgattcaaggatgatagctcatttgaagatgtgaatgggattcggaagccaaagcacctctatgtgtcaatgcctaatgcccagtccagcatgaaagctgaggagattacaccaggaaggtatcggacagctgtgtgcggactttaccctgcacaaattaaggcaaggcaaatggtaagccctgtaatgagtgtgattggtttcatggcgttagctaaggactggactgaccggattgagaactggctgggtgaaccatgcaaattattgccagatacatcatctgttatcctgctcgggggacctgcaacaaatcgagactacatcaggcaaaggcaggtagctctggggaacatggaaacaaaagaggctaaagctgttagacagcatgccgagtcagctggttgcagtatgattgacaatattgactcaccatcatctatttgggtgtttgctggggccccagaccggtgtccaccgacatgtctgttcgttgctggccttgcagaacttggggcattcttctccattctgcaagatatgagaaataccatcatggcatcaaaaacggtcgggacatctgaggaaaagatgagaaagaagtcatcattttaccagtcgtacctgagaaggactcagtcaatgggaatacagttggatcagaggatcattgtcctgttcatggttgcatggggtaaagaggctgtagacaatttccatcttggggatgatatggatccagaactaagaaatcttgctcagagcttgattgaccaaaaggttaaggaaatctctaatcaggagccattaaagctgtaa

SEQ ID NO: 2672 - RNA, 1290 nt, synthetic construct
  misc_feature 1..1290: note = derived and/or modified CDS sequence (wt) from HTNV(YU62)__AY748309.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagagcattaacagacagggaagggcttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcatagtgctctttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2673 - RNA, 1290 nt, synthetic construct
  misc_feature 1..1290: note = derived and/or modified CDS sequence (wt) from HTNV(ZLS6-11)__FJ753396.1__N
  source 1..1290: mol_type = other RNA
atggcaactatggaggaattgcagagagaaatcaatgcccatgagggtcaattggtgatagccaggcagaaggtaagggatgcagaaaaacagtatgagaaagatccagatgagttgaataaaagagcattgacagacagagaaggtgttgcagcatccattcaggctaagattgatgaattgaaaaggcaactggcagataggattgcaaccggaaagaaccttggaaaggaacaggacccaacaggggttgaacctggagaccatctaaaagagaggtcaatgcttagttatggaaacgtgctggatttgaaccatctggatattgatgagcctacaggacagacagccgactggttaagcatagtgatatatctaacatcttttgtggtcccaatacttttgaaagccctgtatatgttaacaacaagagggagacaaacaacaaaagataacaaggggactaggattcgattcaaagatgacagctcttttgaggacatcaatgggattcggaaaccaaagcacctgtatgtgtcattgcccaatgcccaatcaagcatgaaggcagaagagattacaccaggtaggtacagaacagcaatttgtgggctttaccctgcgcagatcaaggctaggcaaatgattagcccagtcatgagtgtgattggattcctagcactggcaaaagactggagtgaccgcattgaacagtggctaagtgagccctgtaaattactcccagacactgcagcagtgagccttcatggaggccctgcaacaaacagggattatctgaggcagaggcaggtggcattgggcaatatggaaacaaaggagtcaaaagccatacgccaacatgctgaaactgcaggctgtagcatgattgaagatatcgagtcaccatcatcaatatgggtttttgcaggagcaccagatcgttgtccaccaacatgtttgtttatcgcaggaattgctgaactcggagcattcttctccatcctgcaggacatgcggaatacaatcatggcatcaaaaacagtgggaacatctgaagaaaaattacggaagaaatcatcattctatcaatcctatctcaggcggactcaatcaatgggaatacaactggaccaaagaatcattgtgctcttcatggttgcttggggtaaagaggcagtggataatttccacctaggtgatgatatggatcccgagttgagaacactagcacagagtttgattgatgttaaagtgaaggaaatctccaaccaagagcctttaaaattgtaa

SEQ ID NO: 2674 - RNA, 1290 nt, synthetic construct
  misc_feature 1..1290: note = derived and/or modified CDS sequence (wt) from HTNV__AB027523.1__N
  source 1..1290: mol_type = other RNA
atggcaacaatggaggagttacagaaagaaatcaatgcccatgagggccagctcataattgcaaagcaaaaggtcaaagatgcagaaaagcaatatgagaaggacccagatgagttaaacaagagggcactgactgacagggaaggagtttcagcatccatccaggctaaaattgatgaactgaaaagacagctagcagacaggattgctacgggaaaaaacctgggacaggatcgggatccaacaggggtagaaccaggggaccacctaaaggagagatcaatgctgagttatgggaacattcttgacttgaaccacctggatatcgatgagccgacagggcaaactgctgactggttgagcatcattgtatatttgacctcatttgtagtcccaatcttgttgaaagcactatacatgttaacaacaagaggaaggcaaacagctaaggacaacaagggaacacggatcagatttaaggatgacagttcttttgaggatgtcaatggaattcggaaacctaaacatctttatgtgtcaatgcctaatgcccaatcaagcatgaaggcagaagagattacaccaggaggctaccgaacagctgtatgtgggctttttcctgcacagatcaaagcaagacagatggttagccctgttatgagtgtgattggcttcatggcattggcaaaggactggactgatcggattgagagctggcttggtgaaccctgcaaacttttaccagacacatcagctgtgagtctcctgggaggaccggcaacaaaccgggactacataaggcaaaggcaggtggcacttgggaacatggaaactaaagaagcaaaggctgttagacaacatgctgaatcagcaggttgtagcatgattgacaacattgactctccatcgtcaatctgggtttttgccggagctccagataggtgtccgcctacatgcctttttattgctggtattgctgagttaggagcattcttctctatcttacaggatatgaggaataccatcatggcatccaagactgtgggaacatctgaggagaaaatgaggaagaagtcttctttttatcagtcctacttgagaagaacgcagtcaatggggatacaactagatcagaggattattgttctgtttatggtggcatggggcaaagaggcggccgataatttccagcatggagatgacatggacccagagctgagaactcttgcacagagtctgattgaccagaaggttaaggaaatttcaaatcaggagcctttaaaattgtag

SEQ ID NO: 2675 - RNA, 1293 nt, synthetic construct
  misc_feature 1..1293: note = derived and/or modified CDS sequence (wt) from HTNV__D25530.1__N
  source 1..1293: mol_type = other RNA
atgatggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaa

SEQ ID NO: 2676 - RNA, 1290 nt, synthetic construct
  misc_feature 1..1290: note = derived and/or modified CDS sequence (wt) from HTNV__M14626.1__N
  source 1..1290: mol_type = other RNA
atggcaactatggaggaattacagagggaaatcaatgcccatgagggtcaattagtgatagccaggcagaaggtgagggatgcagaaaaacagtatgaaaaggatccagatgagttgaacaagagaacattaactgaccgagagggcgttgcagtatctatccaggcaaaaattgatgagttaaaaaggcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactaggccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaa

SEQ ID NO: 2677 - RNA, 1290 nt, synthetic construct
  misc_feature 1..1290: note = derived and/or modified CDS sequence (wt) from HTNV__X95077.1__N
  source 1..1290: mol_type = other RNA
atggcaactatggaggaattacagagggaaatcaatgcccatgagggtcaattagtgatagccaggcagaaggtgagggatgcagaaaaacagtatgaaaaggatccagatgagttgaacaagagaacattaactgaccgagagggtgttgcagtatctatccaggcaaagattgatgagttaaaaaggcaactggcagataggattgcaactgggaagaaccttggaaaagaacaagatccaacaggggtagagcctggagaccatctgaaagagagatcaatgctcagttatggtaatgtgttggatttaaaccacttggatattgatgaacccacaggacagacagcagactggctaagcattgtcgtctatctgacatcctttgttgtcccgacacttctgaaagctctatatatgttgacaacaagggggaggcaaactaccaaggataataaaggaacccggattcgatttaaggatgatagctcgttcgaggatgttaatggtatccgaaaaccaaaacatctgtatgtgtccttgccaaatgcacagtcaagtatgaaggcagaagagattacacctggtagatatagaacagcagtctgtggactctaccctgcacagatcaaggcacggcagatgatcagcccagtcatgagtgtaattggttttctggcattggcaaaagattggagtgatcgtattgaacaatggttaagcgaaccttgcaagctccttccagatacaacagcagttagcctccttggtggtcctgcaacaaacagggactacttacggcagcggcaagtggcattaggtaatatggagacaaaggagtcaaaggctatacgccagcatgcagaagcagctggctgtagcatgattgaagacattgagtcaccatcatcaatatgggtatttgctggggcaccagaccgctgtccgccaacatgtttgtttatagcaggtattgctgagcttggagcatttttctccatcctgcaggatatgcgaaatacaatcatggcatctaagacagttggaacatctgaggagaagctgcgaaagaaatcatcattctatcagtcttacctcaggaggacacaatcaatggggatacaactggatcaaaggattattgtgctctttatggttgcttgggggaaggaagctgtggacaacttccacttaggagatgacatggatcctgagctaagaacactggcacagagcttgattgatgtcaaagtgaaggaaatttccaaccaagagcctttgaaactctaa

SEQ ID NO: 2678 - RNA, 1290 nt, synthetic construct
  misc_feature 1..1290: note = derived and/or modified CDS sequence (wt) from HTNV(CGAa1011)__EF990913.1__N
  source 1..1290: mol_type = other RNA
atggcaactatggaggaattgcagagagaaatcaatgcccatgagggtcaactggtgattgctaggcagaaggtgagagatgcagagaaacagtatgaaaaggaccctgatgagctaaataagagaacattgacagacagagaaggtgttgctgcatcaatccaggcaaagattgatgaactaaaaagacagctagcagataggattgcaacagggaaaaatcttggaaaggaacaggacccaacgggggtagagcctggggatcatctgaaggagagatcaatgcttagctatggaaatgtactggatttgaaccatctggatattgatgagcccacggggcaaacagcagattggctgagtattgttatttacctaacatcctttgttgtcccaatactactgaaggccttgtatatgttgacgacacgggggcgacaaactaccaaagataataagggaaccagaattcgcttcaaagacgacagctcatttgaggatgtgaatggaatccggaaaccaaagcatctagatgtgtccctaccaaatgcacagtcgagcatgaaagcagaagagattacacctgggagatacagaacagcaatttgtggactatatcctgcacagatcaaggccagacaaatgatcagcccggtaatgagtgtgattggttttttagcacttgcaaaggactggagtgaccgcatcgaacagtggttaggtgaaccttgtaagcttctccctgatacagcagcagtgagcctccttggtggtcctgcaacaaatagggattacttacggcagagacaagtagcattaggaaacatggagacaaaagaatcaaaggcaatacgccagcatgctgagactgcaggctgtagcatgatagaggatattgagtcaccatcatcaatatgggtctttgctggagcaccagaccgttgcccaccaacatgcttgtttattgcagggattgctgagttgggggcatttttctcggtcttacaggacatgcgaaacacaataatggcatcaaagacagtaggaacatctgaagagaagcttcgcaagaaatcctcattttaccaatcataccttggaagaacacaatcaatgggaatacaactggaccagagaattattgttctcttcatggttgcttggggcaaagaggcagtggacaatttccatctaggggacgatgtggaccctgaattgaggacactagcacaaagcctgattgatgttaaagtgaaggaaatctctgaccaagaaccattaaagctataa

SEQ ID NO: 2679 - RNA, 1290 nt, synthetic construct
  misc_feature 1..1290: note = derived and/or modified CDS sequence (wt) from HTNV(CGAa1015)__EF990912.1__N
  source 1..1290: mol_type = other RNA
atggcaactatggaggaattgcagagagaaatcaatgcccatgagggtcaactggtgattgctaggcagaaggtgagagatgcagagaaacagtatgaaaaggaccctgatgagctaaataagagaacattgacagacagagaaggtgttgctgcatcaatccaggcaaagattgatgaactaaaaagacagctagcagataggattgcaacagggaaaaatcttggaaaggaacaggacccaacgggggtagagcctggggatcatctgaaggagagatcaatgcttagctatggaaatgtactggatttgaaccatctggatattgatgagcccacggggcaaacagcagattggctgagtattgttatttacctaacatcctttgttgtcccaatactactgaaggccttgtatatgttgacgacacgggggcgacaaactaccaaagataataagggaaccagaattcgcttcaaagacgacagctcatttgaggatgtgaatggaatccggaaaccaaagcatctagatgtgtccctaccaaatgcacagtcgagcatgaaagcagaagagattacacctgggagatacagaacagcaatttgtggactatatcctgcacagatcaaggccagacaaatgatcagcccggtaatgagtgtgattggttatttagcacttgcaaaggactggagtgaccgcatcgaacagtggttaggtgaaccttgtaagcttctccctgatacagcagcagtgagcctccttggtggtcctgcaacaaatagggattacttacggcagagacaagtagcattaggaaacatggagacaaaagaatcaaaggcaatacgccagcatgctgagactgcaggctgtagcatgatagaggatattgagtcaccatcatcaatatgggtctttgctggagcaccagaccgttgcccaccaacatgcttgtttattgcagggattgctgagttgggggcatttatctcggtcttacaggacatgcgaaacacaataatggcatcaaagacagtaggaacatctgaagagaagcttcgcaagaaatcctcattttaccaatcataccttggaagaacacaatcaatgggaatacaactggaccagagaattattgttctcttcatggttgcttggggcaaagaggcagtggacaatttccatctaggggacgatgtggaccctgaattgaggacactagcacaaagcctgattgatgttaaagtgaaggaaatctctgaccaagaaccattaaagctataa

SEQ ID NO: 2680 - RNA, 1290 nt, synthetic construct
  misc_feature 1..1290: note = derived and/or modified CDS sequence (wt) from HTNV(CGAa2)__EU092219.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagaacattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcaaaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaccaaaagaatctaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggatcaaagaatcatagtgctctttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2681 - RNA, 1290 nt, synthetic construct
  misc_feature 1..1290: note = derived and/or modified CDS sequence (wt) from HTNV(CGAa31MP7)__EF990911.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagaacattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacggcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccagagaatcatagtgctctttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2682 - RNA, 1290 nt, synthetic construct
  misc_feature 1..1290: note = derived and/or modified CDS sequence (wt) from HTNV(CGAa31P9)__EF990910.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagaacattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagagattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggatcaaagaatcatagtgctctttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2683 - RNA, 1290 nt, synthetic construct
  misc_feature 1..1290: note = derived and/or modified CDS sequence (wt) from HTNV(CGAa4MP9)__EF990915.1__N
  source 1..1290: mol_type = other RNA
atggcaactatggaggaattgcagagagaaatcaatgcccatgagggtcaactagtgattgctaggcagaaggtgagagatgcagagaaacagtatgagaaggaccctgatgagctaaataagagaacattgacagacagagaaggtgttgcagcatcaatccaggcaaaaattgatgaactaaaaagacagctagcagataggattgcaacagggaaaaatctcgggaaagaacaagacccaacaggggtggagcctggagatcacctaaaggaaagatcaatgcttagctatggaaatgtgctagatttgaaccatctagatattgatgagcctacagggcaaacagcagattggctaagtattgttatttacttaacatcctttgttgtcccaatactactgaaggccttatatatgctgacaacacgggggcgacaaaccaccaaggataataagggaaccagaattcgctttaaagacgacagctcatttgaggatgtgaatggaatccggaaaccaaagcatctctatgtgtcactaccaaacgcacaatcaagcatgaaggcagaagagattacacctgggagatacagaacagcaatttgtggattatatcctgcacagatcaaggccagacaaatgatcagtccggtaatgagtgtgattggcttcttagcacttgcaaaggactggagtgaccgcattgagcagtggttaggtgaaccttgtaagcttctccctgatacagcagcagtaagcctccttggtggtcctgcaacaaatagggattacttaaggcaaagacaggtagcattaggaaacatggagacaaaagaatcaaaggccatacgccagcatgctgagaccgcaggttgtagcatgatagaggatattgagtcaccatcatcaatatgggtctttgctggagcacctgaccgttgtccaccaacatgcttgttcatcgcagggattgctgagttgggggcattcttctcggtcttacaagacatgcggaacacgattatggcatcaaagacagtagggacatctgaagagaaactgcgcaagaaatcctcattttaccagtcatacctcagaagaacacaatcaatgggaatacaactggaccagagaatcattgttctcttcatggttgcttggggcaaagaggcagtggacaacttccatttaggggacgatatggaccctgaattgaggacactagcacaaagcctgattgatgttaaagtgaaggaaatttctaaccaagaaccattaaagctataa

SEQ ID NO: 2684 - RNA, 1290 nt, synthetic construct
  misc_feature 1..1290: note = derived and/or modified CDS sequence (wt) from HTNV(CGAa75)__EU092220.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagaacattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttctgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgaatgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggatcaaagaatcatagtgctctttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2685 - RNA, 1290 nt, synthetic construct
  misc_feature 1..1290: note = derived and/or modified CDS sequence (wt) from HTNV(CGHu1)__EU092218.1__N
  source 1..1290: mol_type = other RNA
atggcaactatggaggaactgcagagggaaatcaatgcccatgagggtcaactggtgatagccaggcagaaggtgagggatgcagaaaagcaatatgagaaagattcagatgagttaaacaagagaacattaacagatcgagagggtgttgcagtatccatccaagcaaagattgatgaattgaagaggcaactggcagatcggattgcaaccggaaagaatcttgggaaagagcaagacccaacaggggtagaacctggagatcatctgaaagagagatcaatgctcagttatggaaatgtgctcgacctaaaccacctggatattgatgagccgacaggacagacagcagactggttgagtattgttgtctatctcacatcacttgttgtcccgatacttctaaaagctctgtatatgttaacaacaaaggggaggcagaccaccaaggacaataaagggactcggattcgattcaaagatgatagctccttcgaggatgtcaatggcattcggaagcctaaacatctatatgtgtctttgcttaatgcacagtcaagtatgaaggcagaagagattacacctggtagatataggacagcaatctgtggaccttatcctgcacaaattaaggcaagacagatgattagtcctgtcatgagtgtgattggattcctggccttggcaaaagattggagtgaccgcattgagcagtggttaagtgaaccctgtaagcttcttccagacacagcggcagttagcctccttggtggtcctgctaccaacagggactacctacggcagcggcaagtggcattaggcaatatggaaacaaaagagtctaaggctatacgccaacatgcagaggcagcaggctgcagcatgattgaggatattgagtcaccatcctcaatatgggtgtctgctggggcaccagaccgatgtccaccaacatgtcttttcattgcaggtattgctgagcttggggcatttttttccatcttgcaggacatgcggaatacaatcatggcatccaagacagttggaacctctgaggagaagctacgaaagaaatcttcattctatcagtcttatctcaggagaacacaatcaatgggaatacaactggatcagaggataattgtgctcttcatggtagcctgggggaaagaagcagtggataacttccacctaggagatgatatggatcctgagctgcgaacactagcacagagcctgattgatgttaaggtgaaggaaatttctaaccaagagcctttaaaattgtaa

SEQ ID NO: 2686 - RNA, 1290 nt, synthetic construct
  misc_feature 1..1290: note = derived and/or modified CDS sequence (wt) from HTNV(CGHu2)__EU363813.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagaacattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagaaagatcaatgctcagttatggaaatgtattggacttgaaccatctggatattgatgagcctactgggcagactgcagactggcttagtattgttatatatctgacatctcttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttctggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccatttcacaggacatgcgaaacacaattatggcctcaaagacagtgggaacatctgaggaaaagctacggaagaaatcatcattctatcagtcttatctcaggcgaacccaatcaatgggaatacaactggatcaaagaatcatagtgctttttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2687 - RNA, 1290 nt, synthetic construct
  misc_feature 1..1290: note = derived and/or modified CDS sequence (wt) from HTNV(CGHu3612)__EF990909.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagagcattaacagacagggaagggcttgcagcatcaatccaggccaagattgatgaactgaaaaggcagctagcggatagggttgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggaccaaagaatcatagtgctctttatggttgcctggggtaaagaggctgtggataatttccaccttggagatgatatggatcctgagctaaggacattggcacaaagcctgattgatgtaaaagtgagggaaatctctaaccaagagcctttaaaactataa

SEQ ID NO: 2688 - RNA, 1290 nt, synthetic construct
  misc_feature 1..1290: note = derived and/or modified CDS sequence (wt) from HTNV(CGRn15)__EU363810.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagaacattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgaccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggatcaaagaatcatagtgctctttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2689 - RNA, 1290 nt, synthetic construct
  misc_feature 1..1290: note = derived and/or modified CDS sequence (wt) from HTNV(CGRn2616)__EU363811.1__N
  source 1..1290: mol_type = other RNA
atggcaactatggaggaactgcagagggaaatcaatgcccatgaaggccaactggtgatagccaggcagaaggtgagggatgcaggaaaacaatatgagaaggatccagatgaactgaacaagagaacattaacagacagggaaggggttgcagcatcaatccaggccaagattgatgaactgaaaaggcagctagcggataggattgcaactggaaaaaaccttggaaaggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatgttaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgggtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggatcaaagaatcatagtgctctttatggttgcctggggtaaagaggctgtggataatttccaccttggagatgatatggatcctgagctaaggacattggcacaaagcctgattgatgtagaagtgaaggaaatctctaaccaagagcctttaaaactataa

SEQ ID NO: 2690 - RNA, 1290 nt, synthetic construct
  misc_feature 1..1290: note = derived and/or modified CDS sequence (wt) from HTNV(CGRn53)__EF990907.1__N
  source 1..1290: mol_type = other RNA
atggcaactatggaagaactacagagggaaatcaatgcccatgagggccagctggtgatagccaggcagaaggtgagggatgcagaaaaacagtatgaaaaggatccagatgaactgaacaaaagagcattaacagacagagaaggggttgcagcatctatccaggctaagattgatgaattgaaaagacagttggcagataggattgcaactggaaagaaccttggaaaggaacaggacccaactggggttgaacctggagaccatcttaaggagagatcaatgcttagctatggcaatgtactggatttaaaccatctggatattgatgagcctacagggcagacagcagactggctaagtattgtcatatatctaacatcatttgttgtcccgatccttctaaaggccttgtatatgttaacaacaagagggagacaaacaaccaaagacaataagggaactaggattcggttcaaggatgatagctcttttgaggatgtcaatggaattcggaaaccaaagcatttatatgtgtccttacctaatgcccaatccagcatgaaggcagaagagataacacctggtaggtatagaacagcaatttgtggactctaccctgcacagatcaaagcgagacaaatgattagccctgtcatgagtgtaattggattcttggcactggcaaaggactggagtgaccgcattgaacagtggcttagtgaaccttgtaaactcctcccggacacagcagcagtaagtcttcatggaggtcctgcaacaaacagggactatctccggcagcggcaggtagcactgggcaatatggaaacgaaggagtcaaaggccatacgtcaacatgctgaagctgcaggctgtagcatgattgaagatattgagtcaccgtcatcaatatgggtctttgccggggcccctgatcgctgcccaccaacatgcctattcattgcagggattgctgaacttggggcatttttttccatcctacaggacatgaggaatacaattatggcttcaaagacagtgggaacatctgaagaaaaattgagaaaaaaatcatcattctaccagtcttatctcaggcgaacacaatcaatgggaatacaactggaccaaaggattatagtgctctttatggttgcctggggtaaagaggcagtagataatttccaccttggagatgatatggatcctgagttgagaacactggcacagagtttgattgatgttaaagtgaaggagatctccaaccaagagcctttaaaactataa

SEQ ID NO: 2691 - RNA, 1290 nt, synthetic construct
  misc_feature 1..1290: note = derived and/or modified CDS sequence (wt) from HTNV(CGRn5310)__EF990906.1__N
  source 1..1290: mol_type = other RNA
atggcaactatggaagaactacagagggaaatcaatgcccatgagggccagctggtgatagccaggcagaaggtgagggatgcagaaaaacagtatgaaaaggatccagatgaaccgaacaaaagagcattaacagacagagaaggggttgcagcatctatccaggctaagattgatgaattgaaaagacagttggcagataggattgcaactggaaagaaccttggaaaggaacaggacccaactggggttgaacctggagaccatcttaaggagagatcaatgcttagctatggcaatgtactggatttaaaccatctggatattgatgagcctacagggcagacagcagactggctaagtattgtcatatatctaacatcatttgttgtcccgatccttctaaaggccttgtatatgttaacaacaagagggagacaaacaaccaaagacaataagggaactaggattcggttcaaggatgatagctcttttgaggatgtcaatggaattcggaaaccaaagcatttatatgtgtccctacctaatgcccaatccagcatgaaggcagaagagataacacctggtaggtatagaacagcaatttgtggactctaccctgcacagatcaaagcgagacaaatgattagccctgtcatgagtgtaattggattcttggcactggcaaaggactggagtgaccgcattgaacagtggcttagtgaaccttgtaaactcctcccggacacagcagcagtaagtcttcatggaggtcctgcaacaaacagggactatctccggcagcggcaggtagcactgggcaatatggaaacgaaggagtcaaaggccatacgtcaacatgctgaagctgcaggctgtagcatgattgaagatattgagtcaccgtcatcaatatgggtctttgccggggcccctgatcgctgcccaccaacatgcctattcattgcagggattgctgaacttggggcatttttttccatcctacaggacatgaggaatacaattatggcttcaaagacagtgggaacatctgaagaaaaattgagaaaaaaatcatcattctaccagtcttatctcaggcgaacacaatcaatgggaatacaactggaccaaaggattatagtgctctttatggttgcctggggtaaagaggcagtagataatttccaccttggagatgatatggatcctgagttgagaacactggcacagagtttgattgatgttaaagtgaaggagatctccaaccaagagcctttaaaactataa

SEQ ID NO: 2692 - RNA, 1290 nt, synthetic construct
  misc_feature 1..1290: note = derived and/or modified CDS sequence (wt) from HTNV(CGRn93MP8)__EF990905.1__N
  source 1..1290: mol_type = other RNA
atggcaactatggaagaactacagagggaaatcaatgcccatgagggccagctggtgatagccaggcagaaggtgagggatgcagaaaaacagtatgaaaaggatccagatgaactgaacaaaagagcattaacagacagagaaggggttgcagcacctatccaggctaagattgatgaattgaaaagacagttggcagataggattgcaactggaaagaaccttggaaaggaacaggacccaactggggttgaacctggagaccatcttaaggagagatcaatgcttagctatggcaatgtactggatttaaaccatctggatattgatgagcctacagggcagacagcagactggctaagtattgtcatatatctaacatcatttgttgtcccgatccttctaaaggccttgtatatgttaacaacaagagggagacaaacaaccaaagacaataagggaagtaggattcggttcaaggatgatagctcttttgaggatgtcaatggaattcggaaaccaaagcatttatatgtgtccttacctaatgcccaatccagcatgaaggcagaagagataacacctggtaggtatagaacagcaatttgtggactctaccctgcacagatcaaagcgagacaaatgattagccctgtcatgagtgtaattggattcttggcactggcaaaggactggagtgaccgcattgaacagtggcttagtgaaccttgtaaactcctcccggacacagcagcagtaagtcttcatggaggtcctgcaacaaacagggactatctccggcagcggcaggtagcactgggcaatatggaaacgaaggagtcaaaggccatacgtcaacatgctgaagctgcaggctgtagcatgattgaagatattgagtcaccgtcatcaatatgggtctttgccggggcccctgatcgctgcccaccaacatgcctattcattgcagggattgctgaacttggggcatttttttccatcctacaggacatgaggaatacaattatggcttcaaagacagtgggaacatctgaagaaaaattgagaaaaaaatcatcattctaccagtcttatctcaggcgaacacaatcaatgggaatacaactggaccaaaggattatagtgctctttatggttgcctggggtaaagaggcagtagataatttccaccttggagatgatatggatcctgagttgagaacactggcacagagtttgattgatgttaaagtgaaggagatctccaaccaagagcctttaaaactataa

SEQ ID NO: 2693 - RNA, 1290 nt, synthetic construct
  misc_feature 1..1290: note = derived and/or modified CDS sequence (wt) from HTNV(CGRn93P8)__EF990904.1__N
  source 1..1290: mol_type = other RNA
atggcaactatggaagaactacagagggaaatcaatgcccatgagggccagctggtgatagccaggcagaaggtgagggatgcagaaaaacagtatgaaaaggatccagatgaactgaacaaaagagcattaacagacagagaaggggttgcagcatctatccaggctaagattgatgaattgaaaagacagttggcagataggattgcaactggaaagaaccttggaaaggaacaggacccaactggggttgaacctggagaccatcttaaggagagatcaatgcttagctatggcaatgtactggatttaaaccatctggatattgatgagcctacagggcagacagcagactggctaagtattgtcatatatctaacatcatttgttgtcccgatccttctaaaggccttgtatatgttaacaacaagagggagacaaacaaccaaagacaataagggaactaggattcggttcaaggatgatagctcttttgaggatgtcaatggaattcggaaaccaaagcatttatatgtgtccttacctaatgcccaatccagcatgaaggcagaagagataacacctggtaggtatagaacagcaatttgtggactctaccctgcacagatcaaagcgagacaaatgattagccctgtcatgagtgtaattggattcttggcactggcaaaggactggagtgaccgcattgaacagtggcttagtgaaccttgtaaactcctcccggacacagcagcagtaagtcttcatggaggtcctgcaacaaacagggactatctccggcagcggcaggtagcactgggcaatatggaaacgaaggagtcaaaggccatacgtcaacatgctgaagctgcaggctgtagcatgattgaagatattgagtcaccgtcatcaatatgggtctttgccggcgcccctgatcgctgcccaccaacatgcctattcattgcagggattgctgaacttggggcatttatttccatcctacaggacatgaggaatacaattatggcttcaaagacagtgggaacatctgaagaaaaattgagaaataaatcatcattctaccagtcttatctcaggcgaacacaatcaatgggaatacaactggaccaaaggattatagtgctctttatggttgcctggggtaaagaggcagtagataatttccaccttggagatgatatggatcctgagttgagaacactggcacagagtttgattgatgttaaagtgaaggagatctccaaccaagagcctttaaaactataa

SEQ ID NO: 2694 - RNA, 1290 nt, synthetic construct
  misc_feature 1..1290: note = derived and/or modified CDS sequence (wt) from HTNV(CGRni1)__EU363812.1__N
  source 1..1290: mol_type = other RNA
atggcaactatggaggaactgcagagggaaatcaatgcccatgaaggccaactggtgatagccaggcagaaggtgagggatgcagaaaaacaatatgagaaggatccagatgaactgaacaagagaacattaacagacagggaaggggttgcagcatcaatccaggccaagattgatgaactgaaaaggcagctagcggataggattgcaactggaaaaaaccttggaagggaacaggatcccactggagtagaacctggagaccatctaaaagagagatcaatgctcagttatggaaatgtattggacttgaaccatctggatattgatgagcctactgggcagactgcagactggcttagtattgttatatatctgacatcttttgttgtcccgatacttctgaaggccttatatatgctcacaacaagaggaaggcagacaaccaaagataacaaagggaccaggattcgattcaaggatgacagctcttttgaggatattaacgggattcgaaagccaaagcatctatatgtgtccttgcccaatgcccaatcaagcatgaaggcagaagagatcacaccaggtaggtacagaacagcaatctgtggactctatcctgcacagatcaaagccagacaaatgattagccctgtcatgagtgtaattggatttttggcgctggcaaaagattggagtgaccgtattgaacagtggttaagtgaaccttgtaagctactcccggacacagcagcagtaagccttcatggaggccctgcaacaaacagggattacctacggcagcgccaggtggcactgggtaatatggaaacaaaagaatcaaaggccatacgtcaacatgctgaatctgcaggttgcagcatggttgaggatattgagtcaccatcatcgatatgggtttttgccggagcaccagatcgctgtccaccgacatgcctgtttattgcagggattgctgaacttggcgcattcttctccattttacaggacatgcgaaacacaattatggcctcaaagacagtgggaacatctgaggaaaagctacggaagaaatcatcattctatcagtcttatctcaggcgaacccaatcaatgggaatacaactggatcaaagaatcatagtgctccttatggttgcctggggtaaagaggctgtggataatttccaccttggagatgatatggatcctgagctaaggacattggcacaaagcctgattgatgtaaaagtgaaggaaatctctaaccaagagcctttaaaactataa

SEQ ID NO: 2695 - RNA, 1290 nt, synthetic construct
  misc_feature 1..1290: note = derived and/or modified CDS sequence (wt) from HTNV(CJAp93)__EF208929.1__N
  source 1..1290: mol_type = other RNA
atggcaactatggaggaactgcagagggaaatcaatgcccatgagggtcaactggtgatagccaggcagaaggtgagggatgcagaaaagcaatatgagaaagatccagatgagttaaacaaaagaacattgacagatcgagagggtgttgcagtatccattcaagcaaagattgatgaattaaagaggcagctagcagataggattgcaacagggaagaatcttggaaaggaacaggacccgacaggggtagaacctggggatcatctgaaagagagatcaatgctcagttatggaaatgtgctcgacctaaaccacctggatattgatgagccgacaggacagacagcagactggttgagtattgttgtctatcttacatcatttgttgtcccgatacttctaaaagctctgtatatgttaacaacaagggggaggcagaccaccaaggacaataaagggactcggattcgattcaaagatgatagctccttcgaggatgtcaatggcattcggaagcccaaacatctatatgtgtctttgcctaatgcacagtcaagtatgaaggcagaagagattacacctggtagatataggacagcaatctgtggactttaccctgcacaaattaaggcaagacagatgattagtccagtcatgagtgtgatcggattcctggctttggcaaaagattggagtgaccgcattgagcaatggttaagtgaaccctgtaagcttcttccagacacagcagcagtcggcctccttggtggtcctgcaaccaacagggactacctacggcaacggcaagtggcattaggcaatatggaaacaaaagagtctaaggctatacgccagcatgcagaggcagcaggctgtagcatgattgaggacattgagtcaccatcatcaatatgggtgtttgccggggcaccagatcgctgtccaccaacatgtcttttcattgcaggtattgctgagcttggggcatttttttccattttgcaggacatgcggaatacgatcatggcatccaagacagttggaacctctgaagagaagctaaggaagaaatcttcattctatcagtcttatctcaggagaacacaatcaatgggaatacaactggaccagaggataattgtgctcttcatggtagcttgggggaaagaagcagtaaataatttccacctaggagatgatatggatcccgagctgcgaacattggcacagagcctgattgatgttaaagtgaaggaaatatccaaccaagaacctttaaaactgtaa

SEQ ID NO: 2696 - RNA, 1290 nt, synthetic construct
  misc_feature 1..1290: note = derived and/or modified CDS sequence (wt) from HTNV(Aa14_207)__KX687234.1__N
  source 1..1290: mol_type = other RNA
atggcaactatggaagaattacagagggaaatcaatgcccatgagggtcaacttgtgatagccaggcagaaggtgagggatgcagaaaaacagtatggaaaggatccagatgagttgaacaagagagcattaacagaccgagagggtgttgcagtatctatccaggcaaagattgatgagttaaagaggcagctggcagataggattgcaactgggaaaaatcttgggaaggaacaagatccaacaggggtagagcctggagaccatctgaaagaaagatcaatgctcagttatggtaatgtgctggatttaaaccatttggatattgatgaacccacaggacagacagcagactggctaagcattgttgtctatcttacatcctttgttgtcccgatacttctgaaagctctatatatgttgacaacaagggggaggcaaactaccaaggataacaaaggaactcggattcgatttaaggatgatagctcgttcgaggacgttaacggcatccgaaaaccaaaacatctttatgtgtccttgccaaatgcacagtcaagtatgaaggcagaagagattacacctggtagatatagaacagcagtctgtggactttaccctgcacagatcaaggcacggcagatgatcagcccagtcatgagtgtgattggtttcctggcattggcaaaggattggagtgatcgtattgaacaatggttaagcgaaccttgcaagctccttccagatacagcagcagttagcctccttggtggtcctgcaacaaacagggactacttacggcagcggcaagtggcattaggcaatatggagacaaaagagtcaaaggctatacgccagcatgcagaagcagctggctgtagcatgattgaggacattgagtcaccatcttcaatatgggtatttgctggagcaccagaccgttgtccaccaacatgtttgtttgtagcaggtattgctgagcttggggcatttttttccatcctgcaggacatgcgaaatacaatcatggcatctaagacagttgggacatctgaggagaagctgcgaaagaaatcatcattctatcagtcttatctcagaaggacacaatcaatggggatacaactggaccaaaggatcattgtgctctttatggttgcttggggaaaggaggctgtggacaacttccacttaggggatgatatggatcctgagctaagaacactagcacagagcttgattgatgtcaaagtgaaggaaatttccaaccaagagcctttaaaactctaa

SEQ ID NO: 2697 - RNA, 1290 nt, synthetic construct
  misc_feature 1..1290: note = derived and/or modified CDS sequence (wt) from HTNV(Aa14_234)__KX687235.1__N
  source 1..1290: mol_type = other RNA
atggcaactatggaggaattacagagggaaattaatgcccatgagggtcaattagtgatagccaggcagaaggttagggatgcagaaaaacagtatgaaaaggatccagatgagttgaacaagagagcattaacagaccgagagggtgttgcagtatctatccaggcaaagattgatgagctaaaaaggcaactggcagataggattgcaactgggaaaaaccttgggaaggaacaagatccaacaggggtagagcctggagaccatctaaaagagagatcaatgctcagttatggtaatgtgctggatttaaaccatttggatattgatgaacccacaggacagacagcagactggctaagcattgttgtctatcttacatcctttgttgtcccgatacttctgaaggctctatatatgctgacaacaagggggaggcaaactaccaaggataacaaaggaacccggattcggtttaaggatgatagctcgttcgaggatgttaacggtatccgaaaaccaaaacatctttatgtgtctttgccaaatgcacagtcaagtatgaaggcagaagagattacacctggtagatatagaacagcagtctgtgggctttatcctgcacagattaaggcacggcaaatgatcagcccagtcatgagcgtgattggttttctggcattggcaaaggattggagtgatcgtattgaacaatggttaggcgaaccttgcaagctccttccagatacagcagcagttagcctccttggtggtcctgcaacaaacagggactacttacggcagcggcaagtggcattaggcaatatggagacaaaggagtcaaaggcaatacgccagcatgcagaagcagctggctgtagcatgattgaggacattgagtcaccatcatcaatatgggtatttgctggagcaccagaccgttgtccaccaacatgtctgtttatagcaggtattgctgagcttggggcatttttttccatcttgcaggacatgcgaaatacaatcatggcatctaagacagttgggacatctgaggagaagctgcgaaagaaatcatcattctatcagtcttacctcaggaggacacaatcaatggggatacaactggaccaaaggattattgtgctctttatggttgcctggggaaaggaggctgtggacaacttccacttaggggatgatatggatcctgagctaagaacgctggcacagagcttgattgatgtcaaagtgaaggaaatctccaaccaagagcctttaaaactctaa

SEQ ID NO: 2698 - RNA, 1290 nt, synthetic construct
  misc_feature 1..1290: note = derived and/or modified CDS sequence (wt) from HTNV(Aa14_239)__KX687236.1__N
  source 1..1290: mol_type = other RNA
atggcaactatggaggaattacagagggaaattaatgcccatgagggtcaattagtgatagccaggcagaaggttagggatgcagaaaaacaggatggaaaggatccagatgagttgaacaagagagcattaacagaccgagagggtgttgcagtatctatccaggcaaagattgatgagctaaaaaggcaactggcagataggattgcaactgggaaaaaccttgggaaggaacaagatccaacaggggtagagcctggagaccatctaaaagagagatcaatgctcagttatggtaatgtgctggatttaaaccatttggatattgatgaacccacaggacagacagcagactggctaagcattgttgtctatcttacatcctttgttgtcccgatacttctgaaggctctatatatgctgacaacaagggggaggcaaactaccaaggataacaaaggaacccggattcggtttaaggatgatagctcgttcgaggatgttaacggtatccgaaaaccaaaacatctttatgtgtctttgccaaatgcacagtcaagtatgaaggcagaagagattacacctggtagatatagaacagcagtctgtgggctttatcctgcacagattaaggcacggcaaatgatcagcccagtcatgagcgtgattggttttctggcattggcaaaggattggagtgatcgtattgaacaatggttaggcgaaccttgcaagctccttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaggacattgagtcaccatcatcaatatgggtatttgctggagcaccagaccgttgtccaccaacatgtctgtttatagcaggtattgctgagcttggggcatttttttccatcttgcaggacatgcgaaatacaatcatggcatctaagacagttgggacatctgaggagaagctgcgaaagaaatcatcattctatcagtcttacctcaggaggacacaatcaatggggatacaactggaccaaaggattattgtgctctttatggttgcctggggaaaggaggctgtggacaacttccacttaggggatgatatggatcctgagctaagaacgctggcacagagcttgattgatgtcaaagtgaaggaaatctccaaccaagagcctttaaaactctaa

SEQ ID NO: 2699 - RNA, 1290 nt, synthetic construct
  misc_feature 1..1290: note = derived and/or modified CDS sequence (wt) from HTNV(AY133/2011)__KY807166.1__N
  source 1..1290: mol_type = other RNA
atggcaactatggaggaattgcagagggaaatcaatgcccatgagggccagttagtgatagccaggcagaaggtaagagatgcagaaaagcaatatgaaaaagatccagatgagctgaacaaaagagcattgacagacagggaaggagttgcagcatccatccaggcaaagattgatgagcttaagcggcaacttgcagacaggattgcaacagggaagaatattggcaaggagcaagacccgacaggagttgagcccggggaccacctaaaagagaggtcaatgctcagttatggaaatgtcctggatctaaaccatctggatattgatgagccgacaggacagactgcagattggttgagcattgtcatctatttgacatcatttgttgttccaatacttctgaaagccctgtacatgttaacaacaagaggaaggcagaccaccaaggacaacaaagggactagaattcggttcaaggatgatagctcatttgaggatgttagcggtatcaggaagccgaaacatctgtatttatctctgcccaatgcacagtcaagcatgaaagcagaagagattacacctggtaggtatcggacagcaatctgtgggctctatcctgcacagatcaaggcaaggcaaatgatcagtccagtcatgagtgtaattggattcttagcactagcaaaggactggagtgaccgtattgagcagtggctgagtgagccttgcaaactcctcccagatacagctgcagtcagcctccatggtggtcctgcaacaaatagggactacttacggcaacgtcaggtggcattgggcaatatggagacaaaagaatcaaaagccatccgccaacatgcagaaactgcaggttgtagcatgattgatgatattgagtcaccgtcatcaatatgggtctttgctggggcacctgaccgttgtccacccacatgtctgtttatagcaggaattgcagagcttggagcattcttctctatattgcaggacatgaggaacaccattatggcatctaaaacagtgggaacatctgaggaaaaattaagaaagaagtcttcattctaccagtcctatctcagaagaacacagtcaatgggaatacagctggatcagagaataatcgtgctctttatggttgcatgggggaaagaagcagttgacaatttccatcttggggatgatatggatcctgagctaagaacactagcacagagcctgattgatgtaaaagtgaaggaaatctctaaccaagagcctttaaaactgtaa

SEQ ID NO: 2700 - RNA, 1290 nt, synthetic construct
  misc_feature 1..1290: note = derived and/or modified CDS sequence (wt) from HTNV(GAN13/2011)__KY807168.1__N
  source 1..1290: mol_type = other RNA
atggcaactatggaggaattgcagagggaaatcaatgcccatgagggccagttagtgatagccaggcagaaggtaagagatgcagaaaagcaatatgaaaaagacccagatgagctgaacaaaagagcattgacagatagggagggagttgcagcatccatccaggcaaagattgatgagcttaagcgacaactagcagacaggattgcaacagggaaaaatcttggcaaggagcaagacccgacaggagttgagcccggagaccacctgaaagagagatcaatgctcagctatgggaatgtcttggatctaaaccacctggatatcgatgagccaacaggacagactgcagattggttaagtattgtcatctatttgacatcatttgttgttccgatactcctgaaggccctgtacatgttaacaacaagagggaggcagaccaccaaagacaacaaagggactagaattcggttcaaggatgatagctcatttgaggatgttaatggtatccggaagccaaaacatttgtatttatctctacccaatgcacagtcaagcatgaaggcagaagagattacacctggtagataccggacagcaatctgcggtctctatcctgcacagattaaggcaaggcaaatgatcagtccagtaatgagtgtaattggattcttagcactggcaaaggactggagtgaccgtattgaacagtggctgagtgaaccttgcaaactcctcccagacacagctgcagtcagcctccatggtggtcctgcaacaaatagagactacttacggcaacgtcaggtagcattgggcaatatggagacaaaagagtcaaaagctatccgccaacatgcagaaactgcaggttgtagcatgattgacgatattgagtcaccatcatcaatatgggtatttgctggggcacctgaccgttgtccacccacatgtctgtttatagcaggaatcgcagagctcggagcatttttctctatattgcaggatatgaggaacacaattatggcatctaaaacagtgggaacatctgaggaaaagttgagaaagaagtcttcattctaccagtcctatctcaggagaacacagtcaatgggaatacagctggatcagagaataattgtgcttttcatggttgcatggggaaaagaagcagttgataatttccatctcggggatgatatggatcctgagctaagaacactagcacagagcctgattgatgtgaaagtgaaggaaatctctaaccaagagcctttaaaattataa

SEQ ID NO: 2701 - RNA, 1290 nt, synthetic construct
  misc_feature 1..1290: note = derived and/or modified CDS sequence (wt) from HTNV(GAN19/2011)__KY807172.1__N
  source 1..1290: mol_type = other RNA
atggcaactatggaggaattgcagagggaaatcaatgcccatgagggccagttagtgatagccaggcagaaggtaagagatgcagaaaagcaatatgaaaaagacccagatgaactgaacaaaagagcattgacagatagggagggagttgcagcatccatccaggcaaagattgatgagcttaagcgacaactagcagacaggattgcaacagggaaaaatcttggcaaggagcaagacccaacaggagttgagcccggagaccacctgaaagagagatcaatgctcagctatgggaatgtcttggatctaaaccatctggatatcgatgagccaacagggcagactgcagattggttaagtattgtcatctatttgacatcatttgttgttccgatactcctgaaggccctgtacatgttaacaacaagagggaggcagaccaccaaagacaacaaagggactagaattcggttcaaggatgatagctcatttgaggatgttaatggtatccggaagccaaaacatttgtatttatctctacccaatgcacagtcaagcatgaaggcagaagagattacacctggtagataccggacagcaatctgcggtctctatcctgcacagattaaggcaaggcaaatgaccagtccagtaatgagtgtaattggattcttagcactggcaaaggactggagtgaccgtattgaacagtggctgagtgaaccttgcaaactcctcccagacacagctgcagtcagcctccatggtggtcctgcaacaagtagagactacttacggcaacgtcaggtagcattgggcaatatggagacaaaagagtcaaaagctatccgccaacatgcagaaactgcaggttgtagcatgattgacgatatcgagtcaccatcatcaatatgggtatttgctggggcacctgaccgttgtccacccacatgtctgtttatagcaggaatcgcagagctcggagcatttttctctatattgcaggatatgaggaacacaattatggcatctaaaacagtgggaacatctgaggaaaagttgagaaagaagtcttcactctaccagtcctatctcaggagaacacagtcaatgggaatacagctggatcagagaataattgtgcttttcatggttgcatggggaaaagaagcagttgataatttccatctcggggatgatatggatcctgagctaagaacactagcacagagcctgatcgatgtgaaagtgaaggaaatctctaaccaagagcctttaaaactataa

SEQ ID NO: 2702 - RNA, 1290 nt, synthetic construct
  misc_feature 1..1290: note = derived and/or modified CDS sequence (wt) from HTNV(LR1)__AF288294.1__N
  source 1..1290: mol_type = other RNA
atggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccagatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaa

SEQ ID NO: 2703 - RNA, 1290 nt, synthetic construct
  misc_feature 1..1290: note = derived and/or modified CDS sequence (wt) from HTNV(RG9)__AF288296.1__N
  source 1..1290: mol_type = other RNA
atggcaactatggaggaactgcagagggaaatcaatgcccatgagggtcaactggtgatagccaggcagaaggtgagggatgcagaaaaacaatatgaaaaggatccagatgagctgaataaaagaacattaacagacagagaaggggttgcagcatctatccaggccaagattgatgaattgaagaggcagttagcagataggattgcaaccggaaagaaccttgggaaagaacaggatcccacaggggttgagcctggagaccatctgaaagagagatcaatgcttagttatggaaatgtattggatttgaaccacctggatattgatgagcctactggacagactgcagattggctcagtattgttatatatttaacatcctttgttgtcccaatacttctaaaggccctatatatgcttacaacaagagggaggcagacaaccaaagataataaagggactaggattcgattcaaggatgacagctcctttgaggatgttaacgggattcggaaaccaaaacatttatatgtttccttgcccaatgcccagtcaagcatgaaggcagaagagatcacaccagggagatacaggacagcaatctgtggactctaccctgcacagattaaggctagacagatgatcagccctgtcatgagtgttattggatttttggctctggcaaaagattggagtgaccgtattgagcagtggctaagtgaaccttgtaagctactcccagatacagcagcagtaagtctccacgggggccctgcaacaaacagggattacctacggcagcgccaagtggcattgggcaatatggaaacaaaagagtcaaaggctatacgtcaacatgctgaatctgcaggttgtagcatgattgaggacattgaatcaccatcatcgatatgggtgtttgctggagcaccagaccgctgtccgccaacatgcttatttattgcagggattgctgaacttggagcattcttttcaatcttacaggacatgcggaataccattacggcgtcaaagacagtaggaacatctgaagagaaattacggaaaaaatcatcattctatcagtcttatctcaggcgaacacaatcaatgggaatacaactggaccagaggattatagtgctattcatggttgcctggggtaaagaggcagtggataacttccaccttggagatgacatggatcctgagttgagaacattggcacaaagcttgattgatgttaaagtgaaggaaatctccaaccaagagcctttaaaactataa

SEQ ID NO: 2704 - RNA, 1290 nt, synthetic construct
  misc_feature 1..1290: note = derived and/or modified CDS sequence (wt) from HTNV(S85-46)__AF288659.1__N
  source 1..1290: mol_type = other RNA
atggcaactatggaggaattacagagggaaatcaatgcccatgagggtcaattagtgatagccaggcagaaggtgagggatgcagaaaaacagtatgaaaaggatccagatgagttgaacaagagtgcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccaggccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacagtcaatggggatacaactagaccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaa

SEQ ID NO: 2705 - RNA, 1290 nt, synthetic construct
  misc_feature 1..1290: note = derived and/or modified CDS sequence (wt) from HTNV(SN7)__AF288657.1__N
  source 1..1290: mol_type = other RNA
atggcaactatggaggaactgcagagggaaatcaatgcccatgagggtcaactggtgatagccaggcagaaggtgagggatgcagaaaaacaatatgaaaaggatccagatgagctgaataaaagaacattaacagacagagaaggggttgcagcatctatccaggccaagattgatgaattgaaaaggcagttagcagataggattgcaaccggaaagaaccttgggaaagaacaggatcccacaggggttgagcctggagaccatctgaaagagagatcaatgcttagttatggaaatgtattggatttgaaccacctggatattgatgagcctactggacagactgcagattggctcagtattgttatatatttaacatcctttgttgtcccaatacttctaaaggccctatatatgcttacaacaagagggaggcagacaaccaaagataataaagggactaggattcgattcaaggatgacagctcctttgaggatgttaacgggattcggaaaccaaaacatttatatgtttccttgcccaatgcccagtcaagcatgaagacagaagagatcacaccagggagatacaggacagcaatctgtggactctaccctgcacagattaaggctagacagatgatcagccctgtcatgagtgttattggatttttggctctggcaaaagattggagtgaccgtattgagcagtggctaagtgaaccttgtaagctactcccagatacagcagcagtaagtctccacgggggccctgcaacaaacagggattacctacggcagcgccaagtggcattgggcaatatggaaacaaaagagtcaaaggctatacgtcaacatgctgaatctgcaggttgtagcatgattgaggacattgaatcaccatcatcgatatgggtgtttgctggagcaccggaccgctgtccgccaacatgcttatttattgcagggattgctgaacttggagcattcttttcaatcttacaggacatgcggaataccattatggcatcaaagacagtaggaacatctgaagagaaattacggaaaaaatcatcattctatcagtcttatctcaggcgaacacaatcaatgggaatacaactggaccagaggattatagtgctattcatggttgcctggggtaaagaggcagtggataacttccaccttggagatgacatggatcctgagttgagaacattggcacaaagcttgattgatgttaaagtgaaggaaatctccaaccaagagcctttaaaactataa

SEQ ID NO: 2706 - RNA, 1290 nt, synthetic construct
  misc_feature 1..1290: note = derived and/or modified CDS sequence (wt) from HTNV(84FLi)__AF366568.1__N
  source 1..1290: mol_type = other RNA
atggcaactatggaggaactgcagagggaaatcaatgcccatgagggtcaactggtgatagccaggcagaaggtgagggatgcagaaaaacaatatgaaaaggatccagatgagctgaataaaagaacattaacagacagagaaggggttgcagcatctatccaggccaagattgatgaattgaaaaggcagttagcagataggattgcaaccggaaagaaccttgggaaagaacaggatcccacaggggttgagcctggagaccatctgaaagagagatcaatgcttagttatggaaatgtattggatttgaaccacctggatattgatgagcctactggacagactgcagattggctcagtattgttatatatttaacatcctttgttgtcccaatacttctaaaggccctatatatgcttacaacaagagggaggcagacaaccaaagataataaagggactaggattcgattcaaggatgacagctcctttgaggatgttaacgggattcggaaaccaaaacatttatatgtttccttgcccaatgcccagtcaagcatgaaggcagaagagatcacaccagggagatacaggacagcaatctgtggactctaccctgcacagattaaggctagacagatgatcagccctgtcatgagtgttattggatttttggctctggcaaaagattggagtgaccgtattgagcagtggctaagtgaaccttgtaagctactcccagatacagcagcagtaagtctccacgggggccctgcaacaaacagggattacctacggcagcgccaagtggcattgggcaatatggaaacaaaagagtcaaaggctatacgtcaacatgctgaatctgcaggttgtagcatgattgaggacattgaatcaccatcatcgatatgggtgtttgctggagcaccaaaccgctgtccgccaacatgcttatttattgcagggattgctgaacttggagcattcttttcaatcttacaggacatgcggaataccattatggcatcaaagacagtaggaacatctgaagagaaattacggaaaaaatcatcattctatcagtcttatctcaggcgaacacaatcaatgggaatacaactggaccagaggattatagtgctattcatggttgcctggggtaaagaggcagtggataacttccaccttggagatgacatggatcctgagttgagaacattggcacaaagcttgattgatgttaaagtgaaggaaatctccaaccaagagcctttaaaactataa

SEQ ID NO: 2707 - RNA, 1290 nt, synthetic construct
  misc_feature 1..1290: note = derived and/or modified CDS sequence (wt) from HTNV(KHF,clone:4)__LC209206.1__N
  source 1..1290: mol_type = other RNA
atggcaactatggaggaattacagagggaaattaatgcccatgagggtcaattagtgatagccaggcagaaggttagagatgcagaaaaacagtatgaaaaggatccagatgagttgaacaagagaacattgacggacagagagggtgttgcagtatctatccaggcaaagattgatgagttaaaaaggcaactggcagataggattgcaactgggaaaaaccttgggaaggaacaagatccaacaggggtagagcctggagaccatctaaaagagagatcaatgctcagttatggtaatgtgctggatttaaaccatttggatattgatgaacccacaggacagacagcagactggctaagcattgttgtctatcttacatcctttgttgtcccgatacttctgaaagctctatatatgttgacaacaagggggaggcaaactaccaaggataacaaaggaacccggattcgatttaaggatgatagctcgttcgaggatgttaacggtatccgaaaaccaaaacatctttatgtgtctttgccaaatgcacagtcaagtatgaaggcagaagagattacacctggtagatatagaacagcagtctgtgggctctaccctgcacagattaaggcacggcaaatgatcagcccagtcatgagtgtgattggttttctggcattggcaaaggattggagtgatcgtattgaacaatggttaagcgaaccttgcaagctccttccagatacagcagcagttagcctccttggtggtcctgcaacaaacagggactacttacggcagcggcaagtggcattaggtaatatggagacaaaggagtcaaaggctatacgccagcatgcagaagcagctggctgtagcatgattgaggacattgagtcaccatcatcaatatgggtatttgctggagcaccagaccgttgtccaccaacatgtttgtttatagcaggtattgctgaacttggggcatttttttccatcttgcaggacatgcgaaatacaatcatggcatctaagacagttgggacatctgaggagaagctgcgaaagaaatcatcattctatcagtcctacctcaggaggacacaatcaatggggatacaactggaccaaaggattattgtgctctttatggtagcctggggaaaggaggctgtggacaacttccacttaggggatgatatggatcctgagctaagaacgctggcacagagcctgattgatgtcaaagtgaaggaaatctccaaccaagagcctttaaaactctaa

SEQ ID NO: 2708 - RNA, 1287 nt, synthetic construct
  misc_feature 1..1287: note = derived and/or modified CDS sequence (wt) from LANV(510B)__AF005727.1__N
  source 1..1287: mol_type = other RNA
atgagcaacctccaagaagtacaggaaggtatcactcttcatgaacaacagcttgttgcagcccgccagaagcttaaggatgccgagaaagcagttgaagtggacccagatgacgttaacaagagcacactacaaagcagacgggcagctgtgtctgcattggagaataaactcgcagaactcaagaggcagttggcagatttggttgcagctcaaaaattggctgcaaaaccagttgatccaacagggcttgaacctgatgaccatctgaaggaaaagtctgctctgcgttatggaaatgtcctggatgtcaatgctattgaccttgaagaaccgagtggccaaactgccgattggaaggctattggagcctatattctaggatttgtaataccaattatcctaaaggcattatatatgctttcaacaagagggaggcagactgttaaagagaacaaagggaccaggattcgattcaaggatgattcatcatttgaagaagtcaatggcatccgaaaacctaaacacttgtatgtgtcaatgcctactgcacaatctacaatgaaggcagatgagataacaccggggaggtttaggacaattgcatgtggcttatttcctgctcaaatcaaagctcggaacattataagtccagtcatgggtgtcattggctttggtcactttgtgaaggactggatggaaaggattgacaactttctaggagaagattgcccatttcttccaaaggctagggttcaatcagaggcattcatgtcaacgaatagggcatattttctaaacaggcagaggcaagtggatgagtcgagaatacaggacattgtggatttaatacaagcagcagaggcaagttcagctacactattcaatgacattgcaacaccacattctgcatgggtttttgcatgtgccccagataggtgtcctccaactgcattatatgttgcaggtgtcccagaactcggggcattctttgccatactccaggatatgagaaatacaatcatggcatctaaatctgttggaacagcagaagaaaagttgaagaagaaatctgccttctaccagtcatatttacggagaactcaatcaatggggatacagttagaccaaaaaatcatcatactttacatgttgtcttggggaaaggaggcagttaatcacttccaccttggtgatgacatggatcctgagcttagacagctggcacagactctcattgatgcaaaggtcaaagagatctctaatcaggaacccctaaaactctaa

SEQ ID NO: 2709 - RNA, 1287 nt, synthetic construct
  misc_feature 1..1287: note = derived and/or modified CDS sequence (wt) from LANV(12234)__ALD61435.1__N
  source 1..1287: mol_type = other RNA
atgagcaccctccaagaagttcaggaaggtattactcttcatgagcagcagcttgttgcagctcgtcagaagcttaaagatgccgagaaagcagttgaagtggacccggatgacgttaacaagagcacattacaaagtagacgggcagctgtgtctgcattggagaataaactcgcagaactcaaaaggcagctggcagatttggttgcagctcaaaaactggctgcaaaaccagttgatccaacagggcttgagcctgatgaccatttgaaggaaaaatctgctctacgttatgggaatgtcttggatgtgaatgcaattgaccttgaagaaccaagtggtcaaacagctgattggaaagcaattggagcttatatcttaggctttgtgatacctataattcttaaggccttatatatgctttcaacaagaggtaggcagactgttaaagagaacaaagggacccggattcgattcaaggatgattcctcgtttgaagaagttaatggcatcaggaagcctaaacagctgtatgtatcaatgcccactgcccaatccacaatgaaggcagatgagataacaccaggaaggtttagaacgatagcatgtggactatttccagctcagatcaaagccaggaacataataagccctgtcatgggtgttattggtttcagtcactttgtgaaagattggatggagcggattgatgatttcttagcagcagactgcccgtttcttcccaaaccaagagtccaatctgaagcatttatggcgacaaacagagcttatttcataaaccggcagcgacaaattgatgaatcaaggatgcctgatattatggatttaatacaagcagcagaagcaggttcagccactctgtttaatgatattgcgacacctcattctgcatgggtatttgcttgtgccccagacagatgtcccccaactgcactctacgtggcaggagtcccagaacttggtgccttctttgcaattcttcaggatatgaggaacacaattatggcatcgaaatctgtagggacggcagaggagaagctaaagaagaaatctgcattctatcaatcatacttgaggaggactcaatcaatggggatacaactggaccaaaagatcattatactctatatgctttcatggggtaaagaggcagtgaatcactttcaccttggtgatgatatggatcctgaactcaggcagttggcacagacattgattgatacaaaggttaaagagatttctaatcaggaacctctaaaactctaa

SEQ ID NO: 2710 - RNA, 1272 nt, synthetic construct
  misc_feature 1..1272: note = derived and/or modified CDS sequence (wt) from LQUV(Longquan-Rs-32)__JX465422.1__N
  source 1..1272: mol_type = other RNA
atggcaacaggaagagatttacaagatgaactggagcaaatagaacaggaaatcactcaagcaaaagcaaaatatgaaaaacaaaaagctgcaataggggaagaacctgatactattgaattgaaggtcttacaacagagagaggagactattcacatgcttgaagaaaagagaaaggagctattacagagaattgctcagcaaatgaaaagtcctagacagccagtaaagggtagagatttagatgaagatgaacatctatctgaacgttcaacattacgctatgggaatgttattgatctggaagaattggatattgatgaaccagcaggtggttctgcagattggctagcaattggaatatacatcttttcctttcctgtccaacttctgttaaaaactttatatattttaactacaagaggccgccaaacaattaaagagaacaagggaaatagattgcgttttaaggactcatcatctactatggatgtaaatggagttaaaacaccacgtcatttgtatatttccttacctactgctcagtcatcaatgaaaacagaggaaatcactccagggcgttatagaacagttgcatgtggtattttatctggagaaatgagggcaagaaaattagtctcacctgttatgggagttattggattcaattacttagcagaaaaatggggagaatatattgatgcatttttaatgaaacagtctcctcatttgcctgtttctactggcagtcctgaaagtgctactaattttgcataccttatacaaagacaagatgtgctcaataaaagtaagactgtagaatacttagaattatgggaacaggcagaaaaggctggtagacaccttgttgatagaattgaatcaccattaactccatggttgtttgcaggttcacctgatcgatgcccccctactagcttatatgtagcaggtattgctgaattaggagcattcttttctatattacaagatataagaaatgcaataatggcatctaaattagtgggaacagcagaagaaaaattaaaaagaaagtcttcattttatcaatcgtatttaaggagaacacaatctatgggggttcaactagaccagagaattataattttgtacatgatggaatggggtaaaatgatggttgatcatttccatcttggagatgatatggactctgagctcagaaaggcttgtcaatctttaattgatgaaaaagtggcacaagtctcaaaccaggaggctttgaaattgtaa

SEQ ID NO: 2711 - RNA, 1272 nt, synthetic construct
  misc_feature 1..1272: note = derived and/or modified CDS sequence (wt) from LQUV(Longquan-Ra-14)__JX465414.1__N
  source 1..1272: mol_type = other RNA
atggcaacaggaagagatttacaagatgaactggagcaaatagaacaggaaatcactcaagcaaaagcaaaatatgaaaaacaaaaagctgcaataggggaagaacatgatactattgaattgaaggtcttacaacagagagaggagactattcacatgcttgaagaaaagagaaaggagctattacagagaattgctcagcaaatgaaaagtcctagacagccagtaaagggtagagatttagatgaagatgaacatctatctgaacgttcaacattacgctatgggaatgttattgatctggaagaattggatattgatgaaccagcaggtggttctgcagattggctagcaattggaatatacatcttttcctttcctgtccaacttctgttaaaaactttatatattttaactacaagaggccgccaaacaattaaagagaacaagggaaatagattgcgttttaaggactcatcatctactatggatgtaaatggagttaaaacaccacgtcatttgtatatttccttacctactgctcagtcatcaatgaaaacagaggaaatcactccagggcgttatagaacagttgcatgtggtattttatctggagaaatgagggcaagaaaattagtctcacctgttatgggagttattggattcaattacttagcagaaaaatggggagaatatattgatgcatttttaatgaaacagtctcctcatttgcctgtttctactggcagtcctgaaagtgctactaattttgcataccttatacaaagacaagatgtgctcaataaaagtaagactgtagaatacttagaattatgggaacaggcagaaaaggctggtagacaccttgttgatagaattgaatcaccattaactccatggttgtttgcaggttcacctgatcgatgcccccctactagcttatatgtagcaggtattgctgaattaggagcattcttttctatattacaagatataagaaatgcaataatggcatctaaattagtgggaacagcagaagaaaaattaaaaagaaagtcttcattttatcaatcgtatttaaggagaacacaatctatgggggttcaactagaccagagaattataattttgtacatgatggaatggggtaaaatgatggttgatcatttccatcttggagatgatatggactctgagctcagaaaggcttgtcaatctttaattgatgaaaaagtggcacaagtctcaaaccaggaggctttgaaattgtaa

SEQ ID NO: 2712 - RNA, 1272 nt, synthetic construct
  misc_feature 1..1272: note = derived and/or modified CDS sequence (wt) from LQUV(Longquan-Ra-25)__JX465415.1__N
  source 1..1272: mol_type = other RNA
atggcaacaggaagagatttacaagatgaactggagcaaatagaacaggaaatcactcaagcaaaagcaaaatatgaaaaacaaaaagctgcaataggggaagaacctgatactattgaattgaaggtcttacaacagagagaggagactattcacatgcttgaagaaaagagaaaggagctattacagagaattgctcagcaaatgaaaagtcctaaacagccagtaaagggtagagatttagatgaagatgaacatctgtctgaacgttcaacattacgctatgggaatgttattgatctggaagaattggatattgatgaaccagcaggtggttctgcagattggctagcaattggaatatacatcttttcctttcctgtccaacttctgttaaaaactttatatattttaactacaagaggccgccaaacaattaaagagaacaagggaaatagattgcgttttaaggactcatcatctactatggatgtaaatggagttaaaacaccacgtcatttgtatatttccttacctactgctcagtcatcaatgaaaacagaggaaatcactccagggcgttatagaacagttgcatgtggtattttatctggagaaatgagggcaagaaaattagtctcacctgttatgggagttattggattcaattacttagcagaaaaatggggagaatatattgatgcatttttaatgaaacagtctcctcatttgcctgtttccactggcagtcctgaaagtgctactaattttgcataccttatacaaagacaagatgtgctcaataaaagtaagactgtagaatacttagaattgtgggaacaggcggaaaaggctggtagacaccttgttgatagaattgaatcaccattaactccatggttgtttgcaggttcacctgatcgatgcccccctactagcttatatgtagcaggtattgctgaattaggagcatttttttctatattacaagatataagaaatgcaataatggcatctaaattagtaggaacagcagaagaaaaattaaaaagaaagtcttcattttatcaatcatatttaaggagaacacaatctatggggattcaactagaccagagaattataattttgtacatgatggaatggggtaaaatgatggttgatcatttccatcttggagatgatatggactctgagctcagaaaggcttgtcaatctttaattgatgaaaaagtggcacaagtctcaaaccaagaggctctgaaattgtaa

SEQ ID NO: 2713 - RNA, 1287 nt, synthetic construct
  misc_feature 1..1287: note = derived and/or modified CDS sequence (wt) from NYV(RI-1)__U09488.1__N
  source 1..1287: mol_type = other RNA
atgagcaccctcaaagaagtgcaagacaacatcacattacacgaacaacagctcgtaactgccaggcagaagcttaaggatgcagaaaaggcagtggaagtggacccagatgacgttaacaaaagcacattacagggtagacgggcggctgtgtctgcattggaaaccaaactcggagaactcaaacgacagctggcagaccttattgcagctcagaaattggcttcgaaacctattgatccaacagggattgaacctgatgaccatttaaaggagaaatcatcactgagatacgggaatgttcttgatgtgaattcaattgatttggaagaaccaagtggccaaacagcagattggaaagctattggaatgtatatcttgagctttgcaataccaatcatcttaaaggccctctatatgttatcaaccagaggtcgtcaaacagttaaggaaaataaggggacaagaatcaggttcaaggatgactcatcttatgaagaagtcaacggaatcagaaagccaagacatttatatgtatcaatgcctacagcccaatccacaatgaaggcagatgagatcactccagggcgtttccgcacgattgcatgtggattgttccctgcacaagtgaaggctaggaatattatcagtccagtcatgggtgtgataggatttaacttttttgttaaggactggatggacaggattgatgattttctagctgagcggtgcccattcctacctgagccaagagaccctaaggatgctgcattaggaacaaatagagcctattttataacacgtcaggcacaagtagatgaatcaaaggttgttgacattgaggaactgattgttgatgcaagagcagagtctgcaactcttttcgcagacattgcaacgccccattcagtctgggtctttgcatgtgcgcctgacaggtgtccccctacagcattatatgtcgctggaatgcctgaacttggtgcattttttgccatacttcaggacatgagaaatacaataatggcatcaaaatctgtagggactgctgaggagaaattaaagaaaaaatcggcattctaccaatcttaccttagacgaactcagtcaatgggaattcaactggatcaaaagataatcatcctttacatgattcattggggaaaggaagctgttaatcactttcaccttggtgatgatatggacccggagttgagagagttagcacaggcccttgttgatgctaaagtcaaagagatttccaaccaggagccgcttaaactgtaa

SEQ ID NO: 2714 - RNA, 1302 nt, synthetic construct
  misc_feature 1..1302: note = derived and/or modified CDS sequence (wt) from PUUV(K27)__L08804.1__N
  source 1..1302: mol_type = other RNA
atgagtgacttgacagacatccaagaggagataacccgccatgagcaacaacttgttgttgccagacaaaaactcaaggatgcagagagagcagtggaagtgtacccggatgacgttatcaagaacacattacaagcaagacaacaaacagtgtcagcactggaggataaactcgcagactacaagagaagaatggcagatgctgtgtcccggaagaaaatggatactaaacctactgacccgactgggattgaacctgatgatcatctcaaggagagatcaagccttagatatggaaatgtccttgatgtgaatgctattgacattgaagaaccaagtggccagacagcagattggtatactatcggagtctatgtaatagggttcacaattcctatcattttgaaggctctatatatgttgtcaacacgtggaagacagactgtaaaggaaaacaaaggaacacggatcaggttcaaggatgacacatcatttgaggatatcaatggcatcaggagaccaaaacacctatatgtatccatgcctactgcccagtccaccatgaaagctgaagaacttacacctggacggttccgtacaatagtatgtggcttattccctacacagatacaagttcgtaacatcatgagtccagtaatgggagtgattggtttttctttcttcgttaaagactggccagaaaaaattagggagtttatggagaaagaatgccctttcataaagccagaagttaaacctgggacaccagcacaggaggtagaatttttgaaaagaaatagagtttacttcatgacccgccaggatgttcttgacaaaaatcatgtggctgacatcgataagttgattgactatgctgcctctggtgaccctacatcgcctgatgacatcaaatctcctaatgcaccatgggtatttgcttgtgcaccagatcggtcgcccccaacatgtatttatgttgctgggatggctgaattaggtgcattcttttccatcttacaggatatgaggaacaccattatggcatctaaaactgtgggcacagcagaagagaaactgaaaaggaagtcctccttctatcaatcatatttgcgccgaacacaatcaatggggattcaacttgatcagaggataatcctactgtacatgttggaatggggaaaagaaatggtggatcatttccatcttggtgatgacatggatcctgagctaaggggccttgctcagtcactcatagaccagaaggtaaaagagatatcaaaccaagaacccttaaagatatga

SEQ ID NO: 2715 - RNA, 1302 nt, synthetic construct
  misc_feature 1..1302: note = derived and/or modified CDS sequence (wt) from PUUV(KS13/855)__KX815394.1__N
  source 1..1302: mol_type = other RNA
atgagtgacttgacagatatccaagaggatataacccgccatgaacaacagcttgttgttgccagacaaaaacttaaagatgcagaaaaagcagtggaaatggacccggatgacgttaacaagaacacactgcaagcaagacaacagacagtgtcagcattggaggataaacttgcagacttcaagagaagaatggcagatgctgtgtccaggaaaaagatggatactaaacctactgacccgactgggattgaacctgatgaccaccttaaggaacgatcaagcctcaggtatggaaatgtccttgatgtaaatgctattgacattgaggagccaagtggccagacagcagattggtatacaataggggtgtatgtgattgggtttacactccctattatcctaaaggccttatacatgctttcaacacgtgggagacagacagtaaaggaaaataaaggaacacgaatacgatttaaggatgatacatcatttgaggacattaatggcatcaggagaccaaagcatttgtatgtttccatgcccactgcccaatcaaccatgaaagcagaagaacttacaccaggtcgatttcgtacaattgtttgtggcctgttcccaactcagatacaagtgcgcaatatcatgagtccagtaatgggtgttattggattctcttttttcgtgaaggattgggcagaaagaatcagagaatttatggagaaagaatgtcctttcatcaaaccagaagtcaagccagggacaccagcacaagaggttgagtttttgaaaaagaataaggtttatttcatgcagcgccaggatgtgcttgacaagaatcatgtggctgatattgataagctaattgactatgcagcctcaggagacccaacatcaccagacaacattgagtctcctaatgcaccatgggtatttgcatgtgcacctgaccgatgcccaccaacatgcatatatgttgcagggatggcagaactaggtgcctttttttcaatcctacaggacatgagaaataccataatggcatctaagactgttggcacagctgaagagaaattgaagaagaaatcctccttttatcaatcgtacctacggcggacccagtcaatggggatacagcttgatcaaagaattatcctcttgtatatgctggaatggggtaaagaaatggtggaccacttccatcttggtgatgacatggatccagagctgagaggtcttgcacaagcactaatagaccagaaagtgaaggaaatttcaaaccaagagcccttaaagatatga

SEQ ID NO: 2716 - RNA, 1302 nt, synthetic construct
  misc_feature 1..1302: note = derived and/or modified CDS sequence (wt) from PUUV(KS14/118)__KX815395.1__N
  source 1..1302: mol_type = other RNA
atgagtgacttaacagatatccaagaggatataacccgccatgagcagcaacttgttgttgccagacaaaaactcaaggatgcagagagagcagtggaagtggacccggatgacgttaacaaaaatacactacaagcaaggcaacagacagtgtcagcactggaggacaaactcgcagatttcaagagacgaatggcagatgctgtgtcccggaagaaaatggatactaagcctactgacccgactgggattgaacctgatgaccaccttaaggagagatcaagcctcagatatggaaatgtccttgatgtaaatgcaattgatattgaagaaccgagtggccaaacagcagactggtacaccataggggtctatgtaatagggttcacaattcccattatcctaaaagcattgtatatgctgtcaacacgtgggagacagactgtaaaagaaaataagggaacacggataagatttaaggatgatacctcatttgaggatattaatggtattaggaggcctaagcacctatatgtttctatgcctactgcccaatccactatgaaggctgaagagctgacacctggaaggtttcgaacaatagtgtgtggcttattccctactcaaatacaggtgcgtaatatcatgagcccggtaatgggggtaattggcttttcattctttgttaagaactggccagaaagaattaaagagttcatggagaaggagtgcccctttataaaaccagaagtcaaaccaggaacaccagcacaggaggtagaattcttaaaaaggaataaagtttatttcatgaatcgccaagatgtccttgacaagaaccatgtggctgacattgataaattaattgactatgccgcctctggagaccctacatcacctgatgacatagagtcccctaatgcaccttgggtatttgcttgtgcaccagatcgctgccccccaacatgcatttatgttgcagggatggcagagttaggtgcgtttttttctattctgcaggatatgagaaataccatcatggcatctaagactgttgggacagcggaagagaaattaaagaagaaatcttccttctatcaatcatatctacgtcggacacaatcaatggggatccaacttgatcaaaggataatcctcctgtatatgttagaatggggaaaagaaatggtggatcattttcatcttggtgatgacatggatcctgagctcaggggtcttgctcaggctcttattgatcagaaggttaaagagatatcaaatcaagagcctttaaaaatataa

SEQ ID NO: 2717 - RNA, 1302 nt, synthetic construct
  misc_feature 1..1302: note = derived and/or modified CDS sequence (wt) from PUUV(LT15/201)__KX757841.1__N
  source 1..1302: mol_type = other RNA
atgagtgacttaacagatatccaagaggatataactcgccatgaacaacagcttgttgttgccagacaaaaacttaaagatgcagaaaaagcagtggagatggacccggatgatgttaacaagaacacactacaagcaaggcaacagacagtgtcagcattggaggataaacttgcagacttcaagagaagaatggcagatgctgtgtccaggaaaaaaatggatactaaacctattgacccgactgggattgaacctgatgatcatctcaaggaacgatcaagcctcaggtatggaaatgtccttgatgtaaatgctattgatattgaagagccaagtggccagacagcagactggtatacaataggggtatatgtgattggtttcacactccctattattctaaaggccctgtacatgctttcaacacgtgggagacaaacagtgaaggaaaataaagggacacggataaggttcaaggatgacacatcatttgaggatattaatggcatcagaagaccaaaacacttgtatgtttccatgcctactgcccaatcaaccatgaaagcagaagaactaacaccaggtcgatttcgtacaattgtttgtggtttgttcccaactcagatacaggtgcgtaacatcatgagtccagtaatgggtgtcattggattctccttttttgtgaaagactgggcagaaagaatcagagaatttatggagaaagaatgtcctttcatcaaaccagaggtgaagccagggacaccagcacaagaggtagagttcttaaaaaagaataaagtttattttatgcaacgccaggatgtgcttgataagaaccatgtggctgatattgataaattgattgactatgcagcctcaggggacccaacatcaccagacaacatagagtctcctaatgcaccatgggtatttgcatgtgcccctgaccgatgcccaccaacatgcatatatgttgcaggaatggcagagttaggtgcatttttttcaatcctacaagatatgaggaataccataatggcatctaaaactgttggtacagctgaagaaaaattgaagaaaaaatcctcattttaccaatcatacctacgacgaactcagtcaatgggaatacagcttgatcagagaattatcctcttgtacatgttggagtggggtaaagaaatggtagatcacttccatcttggtgatgacatggatccagagctaagaggtcttgcacaggcactgatagaccagaaagtgaaagaaatatcaaatcaagagcccttaaagatatga

SEQ ID NO: 2718 - RNA, 1302 nt, synthetic construct
  misc_feature 1..1302: note = derived and/or modified CDS sequence (wt) from PUUV(PUU/Ernstbrunn/Cg641/1995)__AJ888752.1__N
  source 1..1302: mol_type = other RNA
atgagtgacttgacagatatccaagaggatataacccgccatgaacagcaacttgttgttgccagacaaaaactcaaggatgcagagaaggcagtggaaatggacccagatgacgttaacaaaaatacactgcaagcaaggcaacaaacagtgtcagcattggaggacaaactcgcagactttaagcgaagaatggcagatgctgtgtccaggaaaaagatggatactaagcctactgacccgactgggattgaacctgatgaccatctcaaggagcgatcaagccttaggtatggaaatgtccttgatgtgaatgccattgatatagaagagccaagtggccaaacagcagactggtatacaattggagtttatgtcattggctttacactcccaatcatactaaaagccctctacatgttatcaacacgaggaagacaaactgtaaaagagaataaaggaacacgtatacgctttaaggatgatacatcatttgaagacatcaatggcattaaaagaccgaagcatttatatgtatccatgccaacagcccagtcaacaatgaaggcagaaaagcttactccaggtaggtttcggacaattgtgtgtggtcttttcccaactcagattcaggtgcgcaacattatgagtcctgtaatgggggttataggattctctttttttgtaaaggattggtcagagagggtaagagattttatggagaaagaatgcccttttataaaaccagaaatcaaaccaggaacaccccctcaggaggctgagttcctaaaaagaaacaaagtgtacttcatgcagcgccaagatgtgctagataaaaatcatgtggcagatattgataagttgattgattatgctgcctcaggggacccaacatcacctgacaacttagaatcccctaatgcaccatgggtatttgcatgtgctccagatcggtgcccaccaacatgtatctatgttgcagggatggctgaactaggtgcctttttttcgatccttcaagatatgagaaatacgataatggcatccaaaactgtgggcacagctgaagagaaattaaagaagaaatcatctttttaccagtcgtatttgagaaggacccaatcaatgggaatacagcttgaccaaagaatcatcctcttgtacatgcttgaatggggtaaggaaatggttgatcatttccatcttggtgatgatatggatcctgaactcagaggactcgcacaagccctcattgaccagaaagtgaaggaaatatctaaccaggagcccttaaaaatatga

SEQ ID NO: 2719 - RNA, 1302 nt, synthetic construct
  misc_feature 1..1302: note = derived and/or modified CDS sequence (wt) from PUUV(PUU/Klippitztoerl/Cg9/1995)__AJ888751.1__N
  source 1..1302: mol_type = other RNA
atgagtgacttgacagatatccaagaggatataacccgccatgaacagcaacttgttgttgccagacaaaaactcaaggatgcagagaaggcagtggaaatggacccagatgacgttaacaaaaatacactgcaagcaaggcaacaaacagtgtcagcattggaggacaaactcgcagactttaagcgaagaatggcagatgctgtgtccaggaaaaagatggatactaagcctactgacccgactgggattgaacctgatgaccatctcaaggagcgatcaagccttaggtatggaaatgtccttgatgtgaatgccattgatatagaagagccaggtggccaaacagcagactggtatacaattggagtttatgtcattggctttacactcccaattatactaaaagccctctacatgttttcaacacgaggaaggcaaactgtaaaagagaataaaggaacacgtatacgctttaaggatgatacatcatttgaagacatcaatggcattagaagaccgaagcatttatatgtatccatgccaacagcccagtcaacaatgaaggcagaagagcttactccaggtaggtttcggacaattgtgtgtggtcttttcccaactcagattcaggtgcgcaacattatgagtcctgtaatgggggttataggattctctttttttgtaaaggattggtcagagagggtaagagattttatggagaaagaatgcccttttataaaaccagagatcaaaccaggaacaccccctcaggaggctgagttcctaaaaagaaacaaagtgtacttcatgcagcgccaagatgtgctagataaaaatcatgtggcagatattgataagttgattgattatgctgcctcaggggacccaacatcacctgacaacttagaatcccctaatgcaccatgggtatttgcatgtgctccagatcggtgcccaccaacatgtatctatgttgcagggatggctgaactaggtgcctttttttcgatccttcaagatatgagaaatacgataatggcatccaaaactgtgggcacagctgaagagaaattaaagaagaaatcatctttttaccagtcgtatttgagaaggacccaatcaatgggaatacagcttgaccaaagaatcatcctcttgtacatgcttgaatggggtaaggaaatggttgatcatttccatcttggtgatgatatggatcctgaactcagaggactcgcacaagccctcattgaccagaaagtgaaggaaatatctaaccaggagcccttaaaaatatga

SEQ ID NO: 2720 - RNA, 1302 nt, synthetic construct
  misc_feature 1..1302: note = derived and/or modified CDS sequence (wt) from PUUV(Balkan-1)__AJ314600.1__N
  source 1..1302: mol_type = other RNA
atgagtgacttgacagatatccaagaggatataacccgccatgaacagcaacttgttgttgccagacagaaactcaaggatgcagagaaggcagtggaaatggacccagatgacgttaacaaaaatacactgcaagcaaggcaacagacagtgtcagcattggaggacaaactcgcagactttaagcgaagaatggcagatgctgtgtccaggaaaaagatggatactaagcctactgacccgactgggattgaacctgatgaccaccttaaggagcgatcaagccttaggtatggaaatgtccttgatgtgaatgccattgatatagaagagccaagtggtcaaacagcagactggtatacaattggagtttatgtcattggctttacactcccgattatactgaaggcactctatatgttatcaacacgaggaagacagactgtgaaagaaaataaaggaacacgcatacgttttaaggatgatacatcatttgaggacattaatggcattagaagaccaaagcatttatatgtatctatgccaacagcccagtcaacaatgaaggcagaagagcttactcctggcaggttccggacaattgtgtgtggtctcttcccaacccaaattcaggtgcgtaacattatgagtcctgtaatgggggttataggattctctttctttgtaaaggattggtcagagagggtgagagaatttatggagaaagaatgcccctttataaaaccagagattaagccagggacacccccgcaggaggctgagttcttaaaaagaaataaggtgtacttcatgcagcgtcaagatgtgctagataaaaatcatgtggcagatattgataagttgcttgattatgcagcctcaggggatccaacatcacatgacaacatagaatcccctaatgcaccatgggtatttgcatgtgctccagataggtgtccaccaacatgcatttatgttgcagggatggctgaacttggtgcctttttttcaatccttcaagatatgagaaatactataatggcatccaagactgtgggcacagctgaagaaaaactgaagaagaaatcatccttttatcagtcttacttgaggaggactcaatcaatggggatacagcttgaccaaagaatcatcctcctatacatgcttgaatggggtaaggaaatggttgatcattttcatcttggtgatgatatggatcctgaactcagaggacttgcacaggctcttattgaccagaaagtgaaggaaatatctaaccaggagcccttaaaaatatga

SEQ ID NO: 2721 - RNA, 1302 nt, synthetic construct
  misc_feature 1..1302: note = derived and/or modified CDS sequence (wt) from PUUV(Balkan-2)__AJ314601.1__N
  source 1..1302: mol_type = other RNA
atgagtgacttgacagatatccaagaggatataacccgccatgaacagcaacttgttgttgccagacagaaactcaaggatgcagagaaggcagtggaaatggacccagatgacgttaacaaaaatacactgcaagcaaggcaacaaacagtgtcagcattggaggacaaactcgcagactttaagcgaagaatggcagatgctgtgtccaggaaaaagatggatactaagcctactgacccgactgggattgaacctgatgaccacctcaaggagcgatcaagccttaggtatggaaatgtccttgatgtgaatgccattgatatagaagagccaagtggtcaaacagcagattggtatacaattggagtttatgtcattggctttacactcccgattattctgaaggcactctatatgttatcaacacgtggaagacagactgtaaaagaaaataaaggaacacgcatacgttttaaggatgatacatcatttgaggacatcaatggcattagaagaccaaagcatttatatgtatctatgccaacagcccagtcaacaatgaaggcagaagagcttactcctggcaggttccggacaattgtgtttggtctcttcccaactcaaattcaggtgcgcaatattatgagtcctgtgatgggggttataggattctcttttttcgtaaaggattggtcagagagggtgagagaatttatggagaaagaatgcccttttataaaaccagagattaagccaggggcacccccgcaggaggctgagttcttaaaaagaaataaagtgtacttcatgcagcgtcaagatgtgctagataaaaatcatgtggcagatattgataagttgattgattacgcagcctcaggggacccaacatcacctgacaacatagaatcccctaatgcaccatgggtattcgcatgtgctccagataggtgtccaccaacatgcatctatgttgcagggatggctgaacttggtgcctttttttcaatccttcaagatatgagaaatactataatggcatccaagactgtaggcacagctgaagaaaaattgaagaagaaatcatccttttatcagtcttacttgaggagaactcaatcaatggggatacagcttgaccaaagaatcatcctcctatacatgcttgaatggggtaaggaaatggttgaccattttcatcttggtgacgatatggatcctgaactcagaggacttgcacaggctctcattgaccagaaagtgaaggaaatatctaaccaggagcccttaaagatatga

SEQ ID NO: 2722 - RNA, 1302 nt, synthetic construct
  misc_feature 1..1302: note = derived and/or modified CDS sequence (wt) from PUUV(Baltic/205Cg/00)__AJ314599.1__N
  source 1..1302: mol_type = other RNA
atgagtgacttggcagatatacaagaggatataacccgccatgagcagcaacttgttgttgccagacagaaactcaaggatgcagagagagcagtggaggtggacccagatgacgttaacaagaacacactacaagcaaggcaacaaacagtgtcagcactggaagataaacttgcagactacaagagaagaatggcagatgctgtgtcccggaaaaaaatggatactaaacctactgatccgactgggattgaacctgatgaccacctcaaggaaagatcaagccttcgatatggaaatgtccttgatgtaaatgctattgacattgaagagccaagtggtcaaacagcagattggtacactataggagtctatgtgataggatttacacttcctatcatccttaaggcattatatatgttgtcaacacgtggaaggcagactgtaaaggaaaacaaaggaacaaggataagatttaaggatgatacatcatttgaggacattaatggaataaggagaccaaaacatctgtatgtctccatgccaactgctcaatccacaatgaaggcagaggaactcacacctgggcggttccgtacaatagtatgtggtctgttccctactcaaatacaagtacgtaatatcatgagtccagtgatgggggtaattggtttttccttttttgtcaaagactggccagaaagaatcaaagagtttatggagaaggaatgccctttcataaaaccagaagtcaaaccaggaacaccaacacaggaggtagaatttctgaaaaggaataaagtgtactttatgaaccgtcaggatgtccttgacaaaaatcatgttgctgacattgataagctaattgactatgctgcctcaggagatcctacatcacctgatgacatagagtctcctaatgcaccgtgggtatttgcttgtgcaccagatcgatgtcctccaacatgtatttatgttgcagggatggcagagctgggcgcatttttctctatcttgcaggatatgaggagtaccattatggcctctaagactgtaggaacagccgaagagaaattgaagaaaaaatcctcattttaccagtcatacctacgccggacacagtctatgggaatccaacttgatcaaagaataatccttttatacatgttggaatggggaaaagaaatggtggaccacttccatcttggtgatgacatggatcctgaacttaggggtctagctcaggcattgattgatcagaaggtaaaagaaatatcaaatcaagagcccttaaagatatga

SEQ ID NO: 2723 - RNA, 1302 nt, synthetic construct
  misc_feature 1..1302: note = derived and/or modified CDS sequence (wt) from PUUV(Baltic/49Cg/00)__AJ314598.1__N
  source 1..1302: mol_type = other RNA
atgagtgacttggcagatatccaagaggatataacccgccatgagcaacaacttgttgttgccagacagaaactcaaggatgcagagagagcagtggaggtggacccagatgacgttaacaagaacacactacaagcaaggcaacaaacagtgtcagcattggaggacaaacttgcagactacaagagaagaatggcagatgctgtgtcccggaagaagatggatactaaacctactgacccgactgggattgaacctgatgaccacctcaaggagagatcaagcctccgatatggaaatgtccttgatgtaaatgctattgacattgaagagccaagtggtcaaacagcagattggtatactataggagtgtatgtgatagggtttacacttcctatcatcctaaaggcattatatatgttgtcgacacgtgggaggcagactgtgaaggaaaacaaggggacaagaataagatttaaggatgacacatcatttgaggatatcaatggcattaggaggccaaaacatctttatgtatccatgccaactgctcaatctacaatgaaggcagaggaacttacacctgggcgatttcggacaatagtatgtggtctattccctactcaaatacaagtacgcaacatcatgagtccagtgatgggggtaattggtttttccttttttgttaaagactggccagaaaggatcaaagagtttatggagaaggaatgcccttttataaaaccagaagttaaaccaggaacaccagcacaggaggtggaatttctgaaaaggaataaagtgtactttatgaaccgccaggatgtccttgacaaaaatcatgttgctgacattgataagctaattgactatgctgcctcgggagatcctacatcacctgatgacatagagtctcccaacgcaccatgggtatttgcctgtgcaccagaccgatgtcctccaacatgcatttatgttgcagggatggcagagttgggtgcatttttctctattttgcaggatatgagaaataccattatggcctctaagactgtaggaacagctgaagagaaactgaagaaaaaatcctcattctaccaatcatacctacgccggacacaatctatgggaatacaacttgatcaaaggataatccttctatacatgttggaatggggaaaagaaatggtggaccacttccatcttggtgatgacatggatcctgaactcaggggtcttgcccaggcattgattgatcaaaaggtaaaggagatatcaaaccaagagcccttaaagatatga

SEQ ID NO: 2724 - RNA, 1302 nt, synthetic construct
  misc_feature 1..1302: note = derived and/or modified CDS sequence (wt) from PUUV(Pallasjarvi/63Cg/98)__AJ314597.1__N
  source 1..1302: mol_type = other RNA
atgagtgacttgacagatatccaagaggatataacccgccatgaacagcagcttgttgttgccagacaaaaacttaaggatgcagagagagcagtggaagtggacccagatgacgttaataaaaacacactgcaagccaggcaacagacagtgtcagcactggaggataaactcgcagactacaagagaaggatggcagatgctgtgtcccggaaaaaaatggatactaaacctactgacccgactgggattgaacctgatgaccacctcaaggagagatcaagccttaggtatggaaatgtccttgatgtgaatgcaattgatattgaggaaccaagtggccaaacagcagactggtatacgattggagtttatgtaataggattcacacttcccattatccttaaagccttatacatgctttcaacacgtggaagacagactgtaaaggagaataaggggacacgcataaggtttaaggatgatacatcatttgaagacatcaatggcataaggagaccaaagcatttatatgtttccatgcctactgcccagtcaaccatgaaggcagaagaactcacaccaggtagatttcgtacaatagtatgtggtctatttccaactcagattcaagtccgtaacatcatgagtccagtaatgggggttattgggttttcattttttgtaaaggattggtcagagagaatcagagagttcatggaaaaagagtgcccattcataaagccggaggttaagccaggtaccccagcacaagaggttgagatgttgaagagaaataagatctatttcatgcagcgccaggatgtgcttgacaaaaatcatgtggcagacattgataagttaattgactatgcagcctctggagaccccacatcgccagataacattgactctcctaatgcaccttgggtctttgcatgtgcaccagaccgatgtccaccaacatgtatctatgttgcagggatggcggagcttggggccttcttttcaattttgcaggacatgaggaatacaataatggcatccaagactgttggcacagctgaagagaagttaaagaaaaaatcctccttttaccaatcttacttacgtcggactcaatcaatgggaattcaacttgaccaaagaattattctcttgttcatgttggaatggggcaaagagatggtagatcatttccatcttggtgatgacatggacccagagctcagaggtctggcacaggcattgatagatcaaaaggtgaaggagatatcaaaccaagaacctttaaaaatataa

SEQ ID NO: 2725 - RNA, 1302 nt, synthetic construct
  misc_feature 1..1302: note = derived and/or modified CDS sequence (wt) from PUUV(Sotkamo 2009)__HE801633.1__N
  source 1..1302: mol_type = other RNA
atgagtgacttgacagatatccaagaggatataacccgccatgaacagcaacttattgttgccagacaaaaacttaaggatgcagagagagcagtggaagtggacccagatgacgttaataaaaacacactgcaagccaggcaacaaacagtgtcagcactggaggacaaactcgcagactacaagagaaggatggcagatgctgtgtccaggaaaaaaatggatactaaacctactgacccgactgggattgaacctgatgaccacctcaaggagagatcaagccttaggtatggaaatgtccttgatgtaaatgcaattgacattgaagaaccaagtggccaaacagcagattggtatacaattggagtgtatgtgatagggttcacacttcctatcatccttaaagctttatacatgctctcaacgcgtgggagacagactgtaaaggaaaataaggggacacgtataaggtttaaggatgatacatcatttgaagacatcaatggcataaggagaccaaagcatttatatgtttctatgcctactgcccagtcaactatgaaagcagaagaactcacaccaggcagatttcgcacaatagtatgtggtctttttcccactcagatccaggttcgtaacatcatgagtccagttatgggggtcattggtttttcattctttgtgaaggattggtctgagagaatcagagagttcatggaaaaagagtgcccattcataaagcctgaagtaaaaccaggcacaccagcacaagagattgagatgttaaaaagaaataagatctactttatgcagcgccaggatgtgcttgacaaaaatcatgtggcagacattgacaagttaattgactatgcagcctctggagaccctacatcacctgacaacattgattcgcctaatgcaccatgggtctttgcatgtgcaccagaccgatgcccaccaacatgtatctatgttgcagggatggcagagcttggggcctttttttcaatattgcaggacatgagaaacacaataatggcatctaagactgttggcacagcagaagagaaattaaagaaaaagtcttccttttaccaatcttacctgcgtcgaactcaatcaatgggaattcagcttgatcaaagaattatcctcttgtttatgttggaatggggcaaagagatggtagatcacttccatcttggtgatgatatggatccagagctcagaggtcttgcacaggcactgatagatcaaaaggtgaaggaaatatcgaaccaggaaccactaaagatataa

SEQ ID NO: 2726 - RNA, 1302 nt, synthetic construct
  misc_feature 1..1302: note = derived and/or modified CDS sequence (wt) from PUUV(CG 13891)__U22423.1__N
  source 1..1302: mol_type = other RNA
atgagtgacttgacagacattcaggaggatataacccgccatgaacaacagcttgttgttgccagacaaaagctcaaggatgcagaaaaggcggtggagatggacccagatgacgttaacaagaacacattgcaagcaaggcaacagacagtgtcagcactggaagacaaacttgcagacttcaagcgacaaatggcagatgctgtctcaaggaaaaagatggatactaaacctactgacccgactgggattgagcctgatgaccatctcaaggaacgatcaagcctcagatatgggaatgtccttgatgtaaatgccattgatatagaggaaccaagtggtcaaacagcagactggtatacaatcggagtgtatgtcataggctttacacttcctattatcctgaaggccttgtatatgttgtcaacacgtgggagacaaactgtgaaagaaaacaaaggaactcgcattcgtttcaaagatgacacttcttttgaggacattaacggtatcaggagaccaaagcacctatatgtttccatgcctactgctcaatcaaccatgaaggctgaagaactgacccctgggcgatttagaaccatagtatgtggtctattcccaactcaaattcaagtgcgtaacataatgagtcctgtaatgggagtaattggcttctcttttttcgttaaagactgggcagatcggattagagaatctatggaaaaagagtgcccctttctaaaaccagatgtaaagccagggacaccagcccaggaaaccgaatttttaaagaggaataaaatatattttatgcaaagacaagaagtactggataagaatcatgttgctgaaattgataagttgattgattatgcagcttcaggagatccaacatcaccagataacattgagtccccgaatgcaccctgggtatttgcctgtgcacctgatcggtgcccaccgacatgtatttatgttgcagggatggctgaactaggtgcattcttttccatattacaggatatgagaaataccatcatggcatctaaaactgttggtacagcagaagaaaagttaaaaaagaaatcatcattttaccaatcctacttgcggaggacacaatcaatgggaatacagcttgaccaaagaattatcttattgtacatgctggaatggggaaaagaaatggttgatcattttcaccttggcgatgacatggatcctgaactcaggggccttgcacaggcactcattgatcaaaaagtgaaggaaatatctaaccaagagcccttaaaaatataa

SEQ ID NO: 2727 - RNA, 1302 nt, synthetic construct
  misc_feature 1..1302: note = derived and/or modified CDS sequence (wt) from PUUV(CG1820)__M32750.1__N
  source 1..1302: mol_type = other RNA
atgagtgacttgacagacatccaagaggagataacccgccatgagcaacaacttgttgttgccagacaaaaactcaaggatgcagagagagcagtggaagtggacccggatgacgttaacaagagcacattacaagcaagacaacaaacagtgtcagcactggaggataaactcgcagactacaagagaagaatggcagatgctgtgtcccggaagaaaatggatactaaacctactgacccgactgggattgaacctgatgatcatctcaaggagagatcaagccttagatatggaaatgtccttgatgtgaatgctattgacattgaagaaccaagtggccagacagcagattggtatactatcggagtctatgtaatagggttcacaattcctatcattttgaaggctctatatatgttgtcaacacgtggaagacagactgtaaaggaaaacaaaggaacacggatcaggttcaaggatgacacatcatttgaggatatcaatggcatcaggagaccaaaacacctatatgtatccatgcctactgcccagtccaccatgaaagctgaagaacttacacctggacggttccgtacaatagtatgtggcttattccctacacagatacaagttcgtaacatcatgagtccagtaatgggagtgattggtttttctttcttcgttaaagactggccagaaaaaattagggagtttatggagaaagaatgccctttcataaagccagaagttaaacctgggacaccagcacaggaggtagaatttttgaaaagaaatagagtttatttcatgacccgccaggatgttcttgacaaaaatcatgtggctgacatcgataagttgattgactatgctgcctctggtgaccctacatcgcctgatgacatcgaatctcctaatgcaccatgggtatttgcttgtgcaccagatcggtgccccccaacatgtatttatgttgctgggatggctgaattaggtgcattcttttccatcttacaggatatgaggaacaccattatggcatctaaaactgtgggcacagcagaagagaaactgaaaaagaagtcctccttctatcaatcatatttgcgccgaacacaatcaatggggattcaacttgatcagaggataatcctactgtacatgttggaatggggaagagaaatggtggatcatttccatcttggtgatgacatggatcctgagctaaggggccttgctcagtcactcatagaccagaaggtaaaagagatatcaaaccaagaacccttaaagatatga

SEQ ID NO: 2728 - RNA, 1302 nt, synthetic construct
  misc_feature 1..1302: note = derived and/or modified CDS sequence (wt) from PUUV(Bussjo_95-1)__AM746297.1__N
  source 1..1302: mol_type = other RNA
atgagtgacttgacagatatccaagaggatataacccgccatgaacaacagcttgttgttgccagacaaaaacttaaggatgcagagaaggcagtggaaatggacccggatgacgttaacaaaaacacactgcaagcaaggcaacagacagtgtcagcactggaggataaactcgcagacttcaagcgacgaatggcagatgctgtgtccaggaagaaaatggatacaaagcctactgatccaactgggattgagccagatgaccacctcaaggaacgatcaagcctgcgatatggaaatgtccttgatgtgaatgccatcgatatagaagaaccaagtggccaaacagcagattggtatacaattggagtgtatgtaatagggtttacactacctattattttgaaggccttatacatgctttccacacgtgggagacaaactgttaaggagaataaagggacacgtatccgctttaaggatgacacttcatttgaagatatcaatggcattaggcgaccaaagcacctctatgtatctatgcctacagcccagtctactatgaaagcagaggaacttacaccaggtcggtttcgcacaatagtttgtggcttatttcctacacaaattcaagttcgaaatataatgagtccagtaatgggggtgattggcttttccttctttgttaaggactggccagacaggataagagagtttatggaaaaggaatgcccatttataaagccagaagttaaaccagggacaccaacacaggaaattgagttcttaaagaaaaataaagtttactttatggaccgccaaaatgtcctagataagaatcatgtggctgacattgataaattaattgactatgctgcctcaggggacccaacatcaccagataacattgaatctcctaatgcaccgtgggtttttgcatgtgctcctgaccgatgtccaccgacgtgtatctatgttgcagggatggcagaacttggtgcctttttttcaattctgcaagacatgaggaataccataatggcctcaaagaccgtaggcacagctgaagaaaaactcaagaaaaaatcttcattctatcagtcctatttacggcggacacagtcaatgggaatccaacttgatcaaaggattatcctcttgtatatgcttgaatggggaaaagagatggttgaccactttcacctgggtgatgacatggatccggaactcagaggtcttgcccaggcattgattgatcagaaagtaaaggagatatctaatcaggatccacttaagatatga

SEQ ID NO: 2729 - RNA, 1302 nt, synthetic construct
  misc_feature 1..1302: note = derived and/or modified CDS sequence (wt) from PUUV(CG144)__AF367064.1__N
  source 1..1302: mol_type = other RNA
atgagtgacttgacagatattcaagaggatataacccgtcatgaacaacagcttgttgctgccagacaaaaacttaaagatgcagaaagagcagtggagatggacccagatgacgttaataaaaacacactgcaagccaggcaacagacagtgtcagcattggaggataaactcgcagactacaagaggagaatggcagatgctgtgtcccggaaaaagatggatactaagcctgctgacccgactgggattgaacctgatgaccacctcaaggagagatcaagtcttagatatggaaatgtccttgatgtgaatgcaattgatattgaggaaccaagcggccagacagcagattggtataccataggaatttatgtgataggctttacacttcccatcatccttaaagctctatatatgttgtcaacacgtgggagacaaactgtgaaggaaaataaagggacacgtataaggtttaaagatgacacatcatttgaggacataaatggcataaggagaccaaaacacttatatgtttcaatgcctactgcccaatcaacaatgaaagcagaggaactcacacctggtagatttcgcacaatagtatgtggattgtttccaacccagatccaggttcgcaacattatgagcccagttatgggggtcataggcttctcattctttgttaaggactggccagaaaggattagagagtttatggaaaaggaatgcccctttataaaaccagaagttaaaccaggcacaccagcacaggagattgagatgctaaaaaagaataaaatctattttatgcatcgacaggatgtgcttgataaaaatcatgtggcagacattgataagttgattgactatgcagcctctggagatcctacgtcacctgacaatattgactctcctaatgctccatgggtatttgcctgtgctccagatcgatgccccccaacatgcatttatgttgcaggaatggctgagcttggtgctttcttttcaatacttcaggatatgagaaacaccataatggcatcaaagactgttggaacagcagaagagaagctaaagaagaaatcctccttctatcaatcttatttgcgccgaactcaatcgatgggaatacagcttgatcaaaggattatccttctatacatgttagaatggggtaaagaaatggtggatcatttccatcttggtgatgatatggatcctgaattgagggggctagcacaggcactgatagatcaaaaagtgaaagagatatcaaaccaagagccattaaagatataa

SEQ ID NO: 2730 - RNA, 1302 nt, synthetic construct
  misc_feature 1..1302: note = derived and/or modified CDS sequence (wt) from PUUV(CG168)__AF367065.1__N
  source 1..1302: mol_type = other RNA
atgagtgacttgacagatattcaagaggatataacccgtcatgaacaacagcttgttgctgccagacaaaaacttaaagatgcagaaagagcagtggagatggacccagatgacgttaataaaaacacactgcaagccaggcaacagacagtgtcagcattggaggataaactcgcagactacaagaggagaatggcagatgctgtgtcccggaaaaagatggatactaagcctgctgacccgactgggattgaacctgatgaccacctcaaggagagatcaagtcttagatatggaaatgtccttgatgtgaatgcaattgatattgaggaaccaagcggccagacagcagactggtataccataggagtttatgtaataggctttacacttcccatcatccttaaagctctatatatgttgtcaacacgtgggagacaaactgtgaaggaaaataaggggacacgtataaggtttaaagatgacacatcatttgaggacataaatggcataaggagaccaaaacacttatatgtctcaatgcctactgcccaatcaacaatgaaagcagaggaactcacacctggtagatttcgcacaatagtatgtggattgtttccaacccagatccaggttcgcaacattatgagcccagttatgggggtcataggcttctcattctttgttaaggactggccagaaaggattagagagtttatggaaaaggaatgcccctttataaaaccagaagttaaaccaggcataccagcacaggagattgagatgctaaaaaagaataaaatctattttatgcatcgacaggatgtgcttgataaaaatcatgtggcagacatcgataagttgattgactatgcagcctctggagatcctacgtcacctgacaatattgactctcctaatgctccatgggtatttgcctgtgctccagatcgatgccccccaacatgcatttatgttgcaggaatggctgagcttggtgctttcttttcaatacttcaggatatgagaaacaccataatggcatcaaagactgttggaacagcagaagagaagctaaagaagaaatcctccttctatcaatcttatttgcgccgaactcaatcgatgggaatacagcttgatcaaaggattatccttctatacatgttagaatggggcaaagaaatggtggatcatttccatcttggtgatgatatggatcctgaactgagggggctagcacaggcactgatagatcaaaaagtgaaagagatatcaaaccaagagccattaaagatataa

SEQ ID NO: 2731 - RNA, 1302 nt, synthetic construct
  misc_feature 1..1302: note = derived and/or modified CDS sequence (wt) from PUUV(CG17/Baskiria-2001)__AF442613.1__N
  source 1..1302: mol_type = other RNA
atgagtgacttggcagacatccaagaggagataacccgccatgagcaacaacttgttgctgccagacaaaaactcaaggatgcagagagagcagtggaagtggacccggatgacgttaacaagaacacattacaagcaaggcaacaaacagtgtcagcactggaggataaactcgcagactacaagagaagaatggcagatgctgtgtcccggaagaaaatggatactaaacctactgacccgactgggattgaacctgatgatcatctcaaggagagatcaagccttagatatggaaatgtccttgatgtgaatgctattgacattgaagaaccaagtggccagacagcagattggtatactatcggagtctatgtaatagggttcacaattcctatcattttgaaggctctatatatgttgtcaacacgtggaagacagactgtaaaggaaaacaaaggaacacggatcaggttcaaggatgacacatcatttgaggatatcaatggcatcaggagaccaaaacacctatatgtatccatgcctactgcccagtccaccatgaaagctgaagaacttacacctggacggttccgtacaatagtatgtggcttattccctacacagatacaagttcgtaacatcatgagtccagtaatgggagtgattggtttttctttctttgttaaagactggccagaaaaaattagggagtttatggagaaagaatgccctttcataaagccagaagttaaacctgggacaccagcacaggaggtagaatttttgaaaagaaatagagtttatttcatgacccgccaggatgttcttgataaaaatcatgtggctgacatcgataagttgattgactatgctgcctctggtgaccctacatcacctgatgacatcgaatctcctaatgcaccatgggtatttgcttgtgcaccagatcggtgccccccaacatgtatttatgttgctgggatggctgaattaggtgcattcttttccatcttacaggatatgaggaacactattatggcatctaaaactgtgggcacagcagaagagaaactgaaaaagaagtcctccttctatcaatcatatttgcgccgaacacaatcaatggggattcaacttgatcagaggataatcctactgtacatgttggaatggggaaaagaaatggtggatcatttccatcttggtgatgacatggatcctgagctaaggggccttgctcagtcactcatagaccagaaggtaaaagagatatcaaaccaagaacccttaaagatatga

SEQ ID NO: 2732 - RNA, 1302 nt, synthetic construct
  misc_feature 1..1302: note = derived and/or modified CDS sequence (wt) from PUUV(CG215)__AF367066.1__N
  source 1..1302: mol_type = other RNA
atgagtgacttgacagatattcaagaggatataacccgtcatgaacaacagcttgttgctgccagacaaaaacttaaagatgcagaaagagcagtggagatggacccagatgacgttaataaaaacacactgcaagccaggcaacagacagtgtcagcattggaggataaactcgcagactacaagaggagaatggcagatgctgtgtcccggaaaaagatggatactaagcctgctgacccgactgggattgaacctgatgaccacctcaaggagagatcaagtcttagatatggaaatgtccttgatgtgaatgcaattgatattgaggaaccaagcggccagacagcagattggtataccataggagtttatgtgataggctttacacttcccatcatccttaaagctctatatatgttgtcaacacgtgggagacaaactgtgaaggaaaataaaggaacacgtataaggtttaaagatgacacatcatttgaggacataaatggcataaggagaccaaaacacttatatgtctcaatgcctactgcccaatcaacaatgaaagcagaggaactcacacctggtagatttcgcacaatagtatgtggattgtttccaacccagatccaggttcgcaacattatgagcccagttatgggggtcataggcttctcattctttgttaaggactggccagagaggattagagagtttatggaaaaggaatgcccctttataaaaccagaagttaaaccaggcacaccagcacaggagattgagatgctaaaaaagaataaaatctattttatgcatcgacaggatgtgcttgataaaaatcatgtggcagacatcgataagttgattgactatgcagcctctggagatcctacgtcacctgacaatattgactctcctaatgctccatgggtatttgcctgtgctccagatcgatgccccccaacatgcatttatgttgcaggaatggctgagcttggtgctttcttttcaatacttcaggatatgagaaacaccataatggcatcaaagactgttggaacagcagaagagaagctaaagaagaaatcctccttctatcaatcttatttgcgccgaactcaatcgatgggaatacagcttgatcaaaggattatccttctatacatgttagaatggggtaaagaaatggtggatcattttcatcttggtgatgatatggatcctgaactgagggggctagcacagacactgatagatcaaaaagtgaaagagatatcaaaccaagagccattaaagatataa

SEQ ID NO: 2733 - RNA, 1302 nt, synthetic construct
  misc_feature 1..1302: note = derived and/or modified CDS sequence (wt) from PUUV(CG315)__AF367068.1__N
  source 1..1302: mol_type = other RNA
atgagtgacttgacagatattcaagaggatataacccgtcatgaacaacagcttgttgctgccagacaaaaacttaaagatgcagaaagagcagtggagatggacccagatgacgttaataaaaacacactgcaagccaggcaacagacagtgtcagcattggaggataaactcgcagactacaagaggagaatggcagatgctgtgtcccggaaaaagatggatactaagcctgctgacccgactgggattgaacctgatgaccacctcaaggagagatcaagtcttagatatggaaatgtccttgatgtgaatgcaattgatattgaggaaccaagcggccagacagcagattggtataccataggagtttatgtgataggctttacacttcccatcatccttaaagctctatatatgttgtcaacacgtgggagacaaactgtgaaggaaaataaagggacacgtataaggtttaaagatgacacatcatttgaggacataaatggcataaggagaccaaaacacttatatgtctcaatgcctactgcccaatcaacaatgaaagcagaggaactcacacctggtagatttcgcacaatagtatgtggattgtttccaacccagatccaggttcgcaacattatgagcccagttatgggggtcataggcttctcattctttgttaaggactggccagaaaggattagagagtttatggaaaaggaatgcccctttatgaaaccagaagttaaaccaggcacaccagcacaggagattgagatgctaaaaaagaataaaatctattttatgcatcgacaggatgtgcttgataaaaatcatgtggcagacatcgataagttgattgactatgcagcctctggagatcctacgtcacctgacaatattgactctcctaatgctccatgggtatttgcctgtgctccagatcgatgccccccaacatgcatttatgttgcaggaatggctgagcttggtgctttcttttcaatacttcaggatatgagaaacaccataatggcatcaaagactgttggaacagcagaagagaagctaaagaagaaatcctccttctatcaatcttatttgcgccgaactcaatcgatgggaatacagcttgatcaaaggattatccttctatacatgttagaatggggtaaagaaatggtggatcatttccatcttggtgatgatatggatcctgaactaagggggctagcacaggcactgatagatcaaaaagtgaaagagatatcaaaccaagagccattaaagatataa

SEQ ID NO: 2734 - RNA, 1302 nt, synthetic construct
  misc_feature 1..1302: note = derived and/or modified CDS sequence (wt) from PUUV(CRF161)__AF367069.1__N
  source 1..1302: mol_type = other RNA
atgagtgacttgacagatattcaagaggatataacccgtcatgaacaacagcttgttgctgccagacaaaaacttaaagatgcagaaagagcagtggagatggacccagatgacgttaataaaaacacactgcaagccaggcaacagacagtgtcagcattggaggataaactcgcagactacaagaggagaatggcagatgctgtgtcccggaaaaagatggatactaagcctgctgacccgactgggattgaacctgatgaccacctcaaggagagatcaagtcttagatatggaaatgtccttgatgtgaatgcaattgatattgaggaaccaagcggccagacagcagactggtataccataggagtttatgtaataggctttacacttcccatcatccttaaagctctatatatgttgtcaacacgtgggagacaaactgtgaaggaaaataaagggacacgtataaggtttaaagatgacacatcatttgaggacataaatggcataaggagaccaaaacacttatatgtctcaatgcctactgcccaatcaacaatgaaagcagaggaactcacacctggtagatttcgcacaatagtatgtggattgtttccaacccagatccaggttcgcaacattatgagcccagttatgggggtcataggcttctcattctttgttaaggactggccagaaaggattagagagtttatggaaaaggaatgcccctttataaaaccagaagttaaaccaggcacaccagcacaggagattgagatgctaaaaaagaataaaatctattttatgcatcgacaggatgtgcttgataaaaatcatgtggcagacatcgataagttgattgactatgcagcctctggagatcctacgtcacctgacaatattgactctcctaatgctccatgggtatttgcctgtgctccagatcgatgccccccaacatgcatttatgttgcgggaatggctgagcttggtgctttcttttcaatacttcaggatatgagaaacaccataatggcatcaaagactgttggaacagcagaagagaagctaaagaagaaatcctccttctatcaatcttatttgcgccgaactcaatcgatgggaatacagcttgatcaaaggattatccttctatacatgttagaatggggcaaagaaatggtggatcatttccatcttggtgatgatatggatcctgaactgagggggctagcacaggcactgatagatcaaaaagtgaaagagatatcaaaccaagagccattaaagatataa

SEQ ID NO: 2735 - RNA, 1302 nt, synthetic construct
  misc_feature 1..1302: note = derived and/or modified CDS sequence (wt) from PUUV(CRF308)__AF367070.1__N
  source 1..1302: mol_type = other RNA
atgagtgacttgacagatattcaagaggatataacccgtcatgaacaacagcttgttgctgccagacaaaaacttaaagatgcagaaagagcagtggagatggacccagatgacgttaataaaaacacactgcaagccaggcaacagacagtgtcagcattggaggataaactcgcagactacaagaggagaatggcagatgctgtgtcccggaaaaagatggatactaagcctgctgacccgactgggattgaacctgatgaccacctcaaggagagatcaagtcttagatatggaaatgtccttgatgtgaatgcaattgatattgaggaaccaagcggccagacagcagattggtataccataggagtttatgtgataggctttacacttcccatcatccttaaagctctatatatgttgtcaacacgtgggagacaaactgtgaaggaaaataaagggacacgtataaggtttaaagatgacacatcatttgaggacataaatggcataaggagaccaaaacacttatatgtctcaatgcctactgcccaatcaacaatgaaagcagaggaactcacacctggtagatttcgcacaatagtatgtggattgtttccaacccagatccaggttcgcaacattatgagcccagttatgggggtcataggcttctcattctttgttaaggactggccagaaaggattagagagtttatggaaaaggaatgcccctttataaaaccagaagttaaaccaggcacaccagcacaggagattgagatgctaaaaaagaataaaatctattttatgcatcgacaggatgtgcttgataaaaatcatgtggcagacatggataagttgattgactatgcagcctctggagatcctacgtcacctgacaatattgactctcctaatgctccatgggtatttgcctgtgctccagatcgatgccccccaacatgcatttatgttgcaggaatggctgagcttggtgctttcttttcaatacttcaggatatgagaaacaccataatggcatcaaagactgttggaacagcagaagagaagctaaagaagaaatcctccttctatcaatcttatttgcgccgaactcaatcgatgggaatacagcttgatcaaaggattatccttctatacatgttagaatggggtaaagaaatggtggatcatttccatcttggtgatgatatggatcctgaactaagggggctagcacaggcactgatagatcaaaaagtgaaagagatatcaaaccaagagccattaaagatataa

SEQ ID NO: 2736 - RNA, 1302 nt, synthetic construct
  misc_feature 1..1302: note = derived and/or modified CDS sequence (wt) from PUUV(CRF366)__AF367071.1__N
  source 1..1302: mol_type = other RNA
atgactgacttgacagatattcaagaggatataacccgtcatgaacaacagcttgttgctgccagacaaaaacttaaagatgcagaaagagcagtggagatggacccagatgacgttaataaaaacacactgcaagccaggcaacagacagtgtcagcattggaggataaactcgcagactacaagaggagaatggcagatgctgtgtcccggaaaaagatggatactaagcctgctgacccgactgggattgaacctgatgaccacctcaaggagagatcaagtcttagatatggaaatgtccttgatgtgaatgcaattgatattgaggaaccaagcggccagacagcagattggtataccataggaatttatgtgataggctttacacttcccatcatccttaaagctctatatatgttgtcaacacgtgggagacaaactgtgaaggaaaataaagggacacgtataaggtttaaagatgacacatcatttgaggacataaatggcataaggagaccaaaacacttatatgtttcaatgcctactgcccaatcaacaatgaaagcagaggaactcacacctggtagatttcgcacaatagtatgtggattgtttccaacccagatccaggttcgcaacattatgagcccagttatgggggtcataggcttctcattctttgttaaggactggccagaaaggattagagagtttatggaaaaggaatgcccctttataaaaccagaagttaaaccaggcacaccagcacaggagattgagatgctaaaaaagaataaaatctattttatgcatcgacaggatgtgcttgataaaaatcatgtggcagacattgataagttgattgactatgcagcctctggagatcctacgtcacctgacaatattgactctcctaatactccatgggtatttgcctgtgctccagatcgatgccccccaacatgcatttatgttgcaggaatggctgagcttggtgctttcttttcaatacttcaggatatgagaaacaccataatggcatcaaagactgttggaacagcagaagagaagctaaagaagaaatcctccttctatcaatcttatttgcgccgaactcaatcgatgggaatacagcttgatcaaaggattatccttctatacatgttagaatggggtaaagaaatggtggatcatttccatcttggtgatgatatggatcctgaattgagggggctagcacaggcactgatagatcaaaaagtgaaagagatatcaaaccaagagccattaaagatataa

SEQ ID NO: 2737 - RNA, 1302 nt, synthetic construct
  misc_feature 1..1302: note = derived and/or modified CDS sequence (wt) from PUUV(Djaknebole_98-1)__AM746310.1__N
  source 1..1302: mol_type = other RNA
atgagtgatctgacagatatccaagaggatataacccgccatgaacaacagcttgttgttgccaggcaaaaacttaaggatgcagagaaggcagtggaaatggacccggatgacgttaacaaaaacacactgcaagcaaggcaacagacagtgtcagcactggaagataaactcgcagacttcaagcgaagaatggcagatgctgtgtccaggaaaaagatggatacaaagcctactgatccaactgggattgagccagatgaccacctcaaggagcgatcaagcctgcgatatggaaatgtccttgatgtgaatgccatcgatatagaagaaccaagtggtcaaacagcagattggtatacgattggagtgtatgtaatagggtttacactacctattatattgaaggccctatacatgctttctacacgtgggagacaaactgtgaaggagaacaaagggacacgtatcagatttaaggatgacacttcatttgaggatatcaatggcatcagacgaccaaagcacctctatgtatccatgcctacagcccaatctaccatgaaagcagaagagcttacaccaggtcggttccgcacaatagtctgtggcttatttcctacacaaattcaagtccggaatataatgagtccagtaatgggagtgattggcttctccttctttgttaaggattgggcagacaggatacgagagttcatggaaaaggaatgcccatttataaagccagaggttaaaccagggacaccaacacaagagattgaatttttgaagaaaaataaagtctactttatggaccgccagaatgttctagataaaaatcatgtggcagacattgataaattaattgactatgctgcctcaggggatccaacatcaccagataacattgaatcccctaatgcaccatgggtttttgcatgtgcacctgaccgatgtccaccaacttgtatttatgtcgcaggaatggcagaacttggtgcatttttttcaatcctgcaggatatgagaaatactataatggcctcaaagaccgtaggcacagctgaagagaagcttaagaaaaagtcttcattctatcaatcttatttacggcggacacagtcaatgggaatccagcttgatcagaggattattctcttgtatatgcttgaatggggaaaagagatggttgaccactttcatctgggtgatgatatggatcctgagctaagaggtcttgcccaggcactgattgatcagaaggtaaaggaaatatctaatcaggatccacttaagatatga

SEQ ID NO: 2738 - RNA, 1302 nt, synthetic construct
  misc_feature 1..1302: note = derived and/or modified CDS sequence (wt) from PUUV(Fusong 114-05)__EF488804.1__N
  source 1..1302: mol_type = other RNA
atgagtgacttaaaagatatacaggaggacatagcccgccatgagcaacaacttgttgttgccagacaaaagctcagggatgcagaaaaggcagtggagatggacccagatgacgttaacaaaaacacactgcaagcaaggcaacaaacagtgtcagcattggaggataaaattgcagacttcaagagaagaatggcagacattgtgtcccggaaaaagatggatactaagcctgctgacccgactgggattgagcctgatgaccacctcaaggagagatcaagtcttcgatatggaaatgtccttgatgtgaatgccattgacattgaggaaccaagtggtcagacagcagactggtatactattggggtatacataattgaattcacactgcctataatactcaaagccctgtacatgctgtcaacgaggggaaggcagactgccaaagaaaataaagggacacggatccgtttcaaggatgacacttcttttgaggatgtgaatgggatcagacgaccaaaacatctctatgtgtcaatgccaaccgcacagtctaccatgaaggcagaagaactgacaccagggagattcagaacaattgtttgcggcctatttcctacacagattcaagtgagaaatatcatgagccccgtaatgggagtgatcggattctccttctttgcaaaggactggccagataggatcaaagaatttatggagaaagaatgtccctttataaaacctgaagtcaagcctggaacaccagcaaaggaagttgaaatattaaagaggaataagatctatttcatgcagaggcaaggtgtgcttgacaagaatcatgtcccagatattgataaactaatagattatgcagcttcaggtgatccgacatcccccaggaacattgactcaccaaatgcaccatgggtgtttgcatgtgccccagatagatgccccccaacttgtatttatgttgcagggatggcagagttaggtgcctttttttcaatcttgcaggatatgagaaataccatcatggcatcaaagactgtaggaacagctgaagagaaattaaagaaaaaatcatcattttaccaatcttatctgcggcgcacacagtcaatgggaatacagcttgatcaacggataatactgttgtatatgttggaatggggaaaggaaatggttgatcactttcatttgggagatgatatggaccctgagctgaggagtctggcgcaggcattgattgatcagaaggttaaggagatctccaaccaggagcccttaaagatatga

SEQ ID NO: 2739 - RNA, 1302 nt, synthetic construct
  misc_feature 1..1302: note = derived and/or modified CDS sequence (wt) from PUUV(Fusong 199-05)__EF488803.1__N
  source 1..1302: mol_type = other RNA
atgagtgacttaaaagatatacaggaggacatagcccgccatgagcaacaacttgttgctgccagacaaaagctcagggatgcagaaaaggcagtggagatggacccagatgacgttaacaaaaacacactgcaagcaaggcaacaaacagtgtcagcattggaggataaaattgcagacttcaagagaagaatggcagacattgtgtcccggaaaaagatggatactaagcctgctgacccgactgggattgagcctgatgaccacctcaaggagagatcaagtcttcgatatggaaatgtccttgatgtgaatgctatcgacattgaggaaccaagtggtcagacagcagactggtatactattggggtatacataattggattcacactgcctataatactcaaagccctgtacatgctgtcaacgaggggaaggcagactgtcaaagaaaataaagggacacggatccgtttcaaggatgacacttcttttgaggatgtgaatgggattagacgaccaaaacatctctatgtgtcaatgccaaccgcacagtctaccatgaaggcagaagaactgacaccagggaggttcagaacaattgtttgcggcctatttcctacacagattcaagtgagaaatatcatgagccccgtaatgggagtgatcggattctccttctttgcaaaggactggccagataggatcaaggaatttatggagaaagaatgtccctttataaaacctgaagtcaagcctggaacaccagcaaaggaagttgaaatattaaagaggaataagatctatttcatgcagaggcaggatgtgcttgacaagaatcatgtcccagatattgataaactaatagattatgcagcttcaggtgatccgacatccccagagaacattgactcaccaaatgcaccatgggtgtttgcatgtgccccagatagatgccccccaacttgtatttatgttgcagggatggcagagctaggtgcctttttttcaatcttgcaggatatgagaaataccatcatggcatcaaagactgtaggaacagctgaagagaagttaaagaaaaaatcatcattttaccaatcttatctgcggcgcacacagtcaatgggaatacagcttgatcaaaggataatactgttgtatatgttggaatggggaaaggaaatggttgatcacttccacttgggagatgatatggaccctgagctgaggagtctggcgcaggcattgattgatcagaaggttaaggagatctccaaccaggagcccttaaagatatga

SEQ ID NO: 2740 - RNA, 1302 nt, synthetic construct
  misc_feature 1..1302: note = derived and/or modified CDS sequence (wt) from PUUV(Fusong 200-05)__EF211820.1__N
  source 1..1302: mol_type = other RNA
atgagtgacttaaaagatatacaggaggacatagcccgccatgagcaacaacttgttgttgccagacaaaagctcagggatgcagaaaaggcagtggagatggacccagatgacgttaacaaaaacacactgcaagcaaggcaacaaacagtgtcagcattggaggataaaattgcagacttcaagagaagaatggcagacattgtgtcccggaaaaagatggatactaagcctgctgacccgactgggattgagcctgatgaccacctcaaggagagatcaagtcttcgatatggaaatgtccttgatgtgaatgctatcgacattgaggaaccaagtggtcagacagcagactggtatactattggggtatacataattggattcacactgcctataatactcaaagccctgtacatgctgtcaacgaggggaaggcagactgtcaaagaaaataaagggacacggatccgtttcaaggatgacacttcttttgaggatgtgaatgggattagacgaccaaaacatctctatgtgtcaatgccaaccgcacagtctaccatgaaggcagaagaactgacaccagggaggttcagaacaattgtttgcggcctatttcctacacagattcaagtgagaaatatcatgagccccgtaatgggagtgatcggattctccttctttgcaaaggactggccagataggatcaaggaatttatggagaaagaatgtccctttataaaacctgaagtcaagcctggaacaccagcaaaggaagttgaaatattaaagaggaataagatctatttcatgcagaggcaggatgtgcttgacaagaatcatgtcccagatattgataaactaatagattatgcagcttcaggtgatccgacatccccagagaacattgactcaccaaatgcaccatgggtgtttgcatgtgccccagatagatgccccccaacttgtatttatgttgcagggatggcagagctaggtgcctttttttcaatcttgcaggatatgagaaataccatcatggcatcaaagactgtaggaacagctgaagagaagttaaagaaaaaatcatcattttaccaatcttatctgcggcgcacacagtcaatgggaatacagcttgatcaaaggataatactgttgtatatgttggaatggggaaaggaaatggttgatcacttccacttgggagatgatatggaccctgagctgaggagtctggcgcaggcattgattgatcagaaggttaaggagatctccaaccaggagcccttaaagatatga

SEQ ID NO: 2741 - RNA, 1302 nt, synthetic construct
  misc_feature 1..1302: note = derived and/or modified CDS sequence (wt) from PUUV(Fusong 900-06)__EF488806.1__N
  source 1..1302: mol_type = other RNA
atgagtgacttaaaagatatacaggaggacatagcccgccatgagcaacaacttgttgttgccagacaaaagctcagggatgcagaaaaggcagtggagatggacccagatgacgttaacaaaaacacactgcaagcaaggcaacaaacagtgtcagcattggaggataaaattgcagacttcaagagaagaatggcagacattgtgtcccggaaaaagatggatactaagcctgctgacccgactgggattgagcctgatgaccacctcaaggagagatcaagtcttcgatatggaaatgtccttgatgtgaatgccattgacattgaggaaccaagtggtcagacagcagactggtatactattggggtatacataattggattcacactgcctataatactcaaagccctgtacatgctgtcaacgaggggaaggcagactgtcaaagaaaataaagggacacggatccgtttcaaggatgacacttcttttgaggatgtgaatgggatcagacgaccaaaacatctctatgtgtcaatgccaaccgcacagtctaccatgaaggcagaagaactgacaccagggagattcagaacaattgtttgcggcctatttcctacacagattcaagtgagaaatatcatgagccccgtaatgggagtgatcggattctccttctttgcaaaggactggccagataggatcaaagaatttatggagaaagaatgtccctttataaaacctgaagtcaagcctggaacaccagcaaaggaagttgaaatattaaagaggaataagatctatttcatgcagaggcgggatgtgcttgacaagaatcatgtcccagatattgataaactaatagattatgcagcttcaggtgatccgacatccccagagaacattgactcaccaaatgcaccatgggtgtttgcatgtgccccagatagatgccccccaacttgtatttatgttgcagggatggcagagttaggtgcctttttttcaatcttgcaggatatgagaaataccatcatggcatcaaagactgtaggaacagctgaagagaaattaaagaaaaaatcatcattttacaaatcttatctgcggcgcacacagtcaatggggatacagcttgatcaacggataatactgttgtatatgttggaatggggaaaggaaatggttgatcactttcatttgggagatgatatggaccctgagctgaggagtctggcacaggcattgattgatcagaaggttaaggagatctccaaccaggagcccttaaagatatga

SEQ ID NO: 2742 - RNA, 1302 nt, synthetic construct
  misc_feature 1..1302: note = derived and/or modified CDS sequence (wt) from PUUV(Gumboda_98-2)__AM746316.1__N
  source 1..1302: mol_type = other RNA
atgagtgatttgacagatatccaagaggatataacccgccatgaacaacaacttgttgttgccaggcaaaaacttaaggatgcagagaaggcagtggaaatggacccggatgacgttaacaagaacacactgcaagcaaggcaacagacagtgtcagcactggaggataaactcgcagacttcaagcgaagaatggcagatgctgtgtccaggaaaaagatggatacaaagcctactgatccaactgggattgagccagatgaccacctcaaggagcgatcaagcctgcgatatggaaatgtccttgatgtgaatgccattgatatagaagagccaagtggccaaacagcagattggtatacaattggagtgtatgtgatagggttcacactacctattattttgaaagccctatacatgctttccacacgtgggagacaaactgtgaaggagaataaagggacacgtatcagatttaaggatgacacttcatttgaggatatcaatggcattagacgaccaaagcacctctatgtatccatgcctacagcccaatctaccatgaaagcagaagaacttacaccaggtcggttccgcacaatagtctgtggcttattccccacacaaattcaagtccgaaatataatgagtccagtaatgggagtgattggcttctctttctttgttaaggattgggcagacaggatacgagagttcatggaaaaggaatgcccatttataaagccagaggttaaaccagggacaccaacacaagaaattgaattcttaaagaaaaataaagtttactttatggaccgccaaaatgttctagaaaaaaatcatgtggctgacattgataaattaattgactatgctgcctcgggggatccaacatcaccagataacattgaatcccctaatgcaccatgggttttttcatgtgcacctgaccgatgtccaccaacttgtatttatgttgcaggaatggcagaacttggtgcatttttttcaatcctgcaggatatgagaaataccataatggcctcaaagaccgtaggcacagctgaagagaagcttaagaaaaagtcctcattctatcaatcttatttgcggcgaacacagtcaatgggaatccagcttgatcagaggattattctcttgtatatgcttgaatggggaaaagagatggttgaccactttcatctgggtgatgacatggatcctgagcttagaggtcttgcccaggcactgattgatcagaaggtaaaagaaatatccaatcaggatccacttaagatatga

SEQ ID NO: 2743 - RNA, 1302 nt, synthetic construct
  misc_feature 1..1302: note = derived and/or modified CDS sequence (wt) from PUUV(Gumboda_98-4)__AM746318.1__N
  source 1..1302: mol_type = other RNA
atgagtgatttgacagatatccaagaggatataacccgccatgaacaacaacttgttgttgccaggcaaaaacttaaggatgcagagaaggcagtggaaatggacccggatgacgttaacaagaacacactgcaagcaaggcaacagacagtgtcagcactggaggataaactcgcagacttcaagcgaagaatggcagatgctgtgtccaggaaaaagatggatacaaagcctactgatccaactgggattgagccagatgaccacctcaaggagcgatcaagcctgcgatatggaaatgtccttgatgtgaatgccattgatatagaagagccaagtggccaaacagcagattggtatacaattggagtgtatgtgatagggttcacactacctattattttgaaagccctatacatgctttccacacgtgggagacaaactgtgaaggagaataaagggacacgtatcagatttaaggatgacacttcatttgaggatatcaatggcattagacgaccaaagcacctctatgtatccatgcctacagcccaatctaccatgaaagcagaagaacttacaccaggtcggttccgcacaatagtctgtggcttattccccacacaaattcaagtccgaaatataatgagtccagtaatgggagtgattggcttctctttctttgttaaggattgggcagacaggatacgagagttcatggaaaaggaatgcccatttataaagccagaggttaaaccagggacaccaacacaagaaattgaattcttaaagaaaaataaagtttactttatggaccgccaaaatgttctagataaaaatcatgtggctgacattgataaattaattgactatgctgcctcgggggatccaacatcaccagataacattgaatcccctaatgcaccatgggttttttcatgtgcacctgaccgatgtccaccaacttgtatttatgttgcaggaatggcagaacttggtgcatttttttcaatcctgcaggatatgagaaataccataatggcctcaaagaccgtaggcacagctgaagagaagcttaagaaaaagtcctcattctatcaatcttatttgcggcgaacacagtcaatgggaatccagcttgatcagaggattattctcttgtatatgcttgaatggggaaaagagatggttgaccactttcatctgggtgatgacatggatcctgagcttagaggtcttgcccaggcactgattgatcagaaggtaaaagaaatatccaatcaggatccacttaagatatga

SEQ ID NO: 2744 - RNA, 1302 nt, synthetic construct
  misc_feature 1..1302: note = derived and/or modified CDS sequence (wt) from PUUV(Kamiiso-8Cr-95)__AB010730.1__N
  source 1..1302: mol_type = other RNA
atgagtgacttgaaagatatccaggaggatataacccgccatgaacaacaacttgttgttgcccggcaaaagcttagagatgcagagaaagcagtggaaatggacccagatgacgttaacaagaacacactgcaagcacggcaacaaacagtgtcagcattggaagataaacttgccgacttcaagcgaagaatggcagatgttgtgtccaggaaaaagatggatactaagcctgctgacccgactgggattgaacctgatgaccacctcaaggagagatctagcctcagatatgggaatgtccttgatgtgaatgcaattgacatagaagagcctagtggtcaaacagcagactggtataccataggagtatatataatagggtttacactacctattattctaaaggcactttacatgttgtcaacccgaggacgtcaaactgtgaaagaaaataaagggacgaggatccgatttaaggatgatacatcatttgaagacattaacgggattagaaggccaaaacatctgtatgtgtccatgcccacagctcaatcaacaatgaaggctgaggagattacacctgggaggtttcgcaccatagtctgtggccttttcccgacacaaattcaagttcggaatataatgagtcctgtcatgggggttattggattctcattctttgttaaagactggcctgagcgaattaaagaatttatggagaaggagtgcccatttataaagccggaggtgaagccaggaaccccagcaaaagaggtggagattttaaaaagaaacaaagtttacttcatgcaacggcaggatgtgcttgataagaatcatgtccccgacatcgataaactaattgactatgcagcctctggagatcccacatcacctgacaatattgactccccaaatgccccatgggtgtttgcatgtgcccctgataggtgcccaccaacatgtatctatgttgcaggaatggcagagctaggggcattcttttccatcctgcaagatatgagaaacaccataatggcgtctaaaactgttgggacagctgaagaaaaactaaagaaaaaatcatctttctaccaatcatatttaaggcgcactcaatcaatggggattcaactcgaccaaaggataatcttgttatacatgcttgagtggggaaaagagatggtagatcactttcatcttggggatgatatggatcctgagcttagagggctggcacaggcattgattgatcagaaagtaaaggaaatttcgaaccaggaaccactaaagatatga

SEQ ID NO: 2745 - RNA, 1302 nt, synthetic construct
  misc_feature 1..1302: note = derived and/or modified CDS sequence (wt) from PUUV(Mu/07/1219)__KJ994776.1__N
  source 1..1302: mol_type = other RNA
atgagtgacttaacagacattcaagaggatataacccgccatgaacaacaacttgtggttgccaggcaaaagcttaaggatgcagagaaggcagtggagatggacccagatgacgttaacaagaatacattgcaagccaggcaacaaacagtgtcagcattggaagacaaacttgcagactacaagcgaagaatggcagatgctgtgtccaggaaaaaaatggatactaagcctactgatccgactgggattgaacctgacgatcacctcaaggaacggtcaagtctcaggtatggaaatgtccttgatgtgaatgccattgatatagaagagcctagtggtcaaacagcagattggtatacaattggagtctatgtcattggctttacacttcccattatcctgaaagctctatatatgttatcaacacgtgggagacagactgtaaaggaaaataaagggacacgtattcggtttaaggatgatacttcatttgaggatattaatggtattaggaggccaaaacatctgtatgtgtccatgccaactgctcaatcaactatgaaggctgaagagctgacccctggtcgatttagaactatagtgtgtggcttgttcccaactcagattcaagtgcgaaacataatgagtcctgtgatgggggttataggcttttcattctttgtcaaggattgggcagaacggattagagagtttatggaaaaagaatgcccctttattaaaccagaggtcaagccaggaacaccagcacaggaggctgaatttttaaagagaaataaagtctattttatgcagcgacaggatgtactcgataaaaaccatgtggctgacattgataaactgattgattatgcagcttcaggagaccctacatcaccagacaacattgaatctcctaatgcaccatgggtatttgcctgtgcccctgatcgatgcccaccaacatgtatttatgttgcagggatggcagagttaggtgcatttttttccatattgcaggacatgagaaatactattatggcatctaagactgttggaacagcagaggaaaaattaaaaaagaaatcatcattttatcagtcatatttacgaagaactcaatcaatgggaatacaactggaccaaaggattatcttattgtatatgcttgaatggggtaaagaaatggtagaccactttcatctgggtgatgatatggatcctgaactcagaggtcttgcacaagcactcattgatcaaaaagtgaaagaaatatctaatcaagagcctttaaaaatatga

SEQ ID NO: 2746 - RNA, 1302 nt, synthetic construct
  misc_feature 1..1302: note = derived and/or modified CDS sequence (wt) from PUUV(Opina916)__AF294652.1__N
  source 1..1302: mol_type = other RNA
atgagtgacttgacagacattcaggaggatataactcgccatgaacaacaacttgttgttgccagacaaaaacttaaggatgcagagaaggcagtggagatggacccagatgacgttaacaaaaacacactgcaagcaagacaacagacagtgtcagcactggaagacaaactggcagacttcaagcgaagaatggcagatgctgtgtccaggaaaaagatggatactaagcctgttgacccgactgggattgaacctgatgaccacctcaaggagcgatcaagcctcaggtatggaaatgtccttgatgtgaatgccattgatatagaggaaccaagtggacaaacagcagattggtatacaattggagtatatgttataggctttacactccctatcatattaaaggccttatacatgttatcaacacgaggaagacagactgtgaaggaaaataaggggactcgtattcgatttaaggatgatacttcatttgaggatatcaatggcattagaagaccaaagcacttgtatgtgtccatgcctactgcccagtcaactatgaaggctgaagaattaacccctggccggtttagaacaatagtatgtggcctgtttccaacccagattcaagtacgtaacataatgagtcctgtaatgggggttattggattttcattctttgtaaaggattgggcagaacgaatcagggaatttatggagaaggaatgtccgtttatcaagccagaggttaaaccagggacaccagcacaggaagctgaatttttgaagaagaataggatatattttatgcaacgccaagaagtgcttgacaaaaaccatgtggctgatattgataaactaatcgattatgcagcctcaggagatcctacatcacctgacaacattgaatctcctaatgcaccatgggtctttgcttgtgctcctgatcgttgtccaccaacatgcatctatgttgcaggaatggctgaattgggtgcatttttctctattttacaggatatgaggaacactattatggcgtctaaaactgttggtacagctgaggaaaaattgaagaaaaagtcatctttctatcagtcgtacttgcggaggactcagtccatgggaatacagcttgaccaaagaatcattctactttatatgctggaatggggcaaagaaatggtggatcacttccatctgggtgatgatatggatcctgagctcaggggacttgcacaagcacttattgaccagaaagtgaaagaaatatccaatcaagaacccttaaagatatga

SEQ ID NO: 2747 - RNA, 1302 nt, synthetic construct
  misc_feature 1..1302: note = derived and/or modified CDS sequence (wt) from PUUV(Palbole_98-1)__AM746327.1__N
  source 1..1302: mol_type = other RNA
atgagtgatctgacagatatccaagaggatataacctgccatgaacaacagcttgttgttgccaggcaaaaacttaaggatgcagagaaggcagtggaaatggacccggatgacgttaacaaaaacacactgcaagcaaggcaacagacagtgtcagcactggaagataaactcgcagacttcaagcgaagaatggcagatgctgtgtccaggaaaaagatggatacaaagcctactgatccaactgggattgagccagatgaccacctcaaggagcgatcaagcctgcgatatggaaatgtccttgatgtgaatgccattgatatagaagaaccaagtggtcaaacagcagattggtatacaattggagtgtatgtaatagggtttacactacctattatattgaaggccctatacatgctttctacacgtgggagacaaactgtgaaggagaacaaagggacacgtatcagatttaaggatgacacttcatttgaggatatcaatggcatcagacgaccaaagcacctctatgtatccatgcctacagcccaatctaccatgaaagcagaagagcttacaccaggtcggttccgcacaatagtctgtggcttattccctacacaaattcaagtccggaatataatgagtccagtaatgggagtgattggcttctctttctttgttaaggattgggcagacaggatacgagagttcatggaaaaggaatgcccatttataaagccagaggttaaaccagggacaccaacacaagagattgaatttttgaagaaaaataaagtctactttatggaccgccagaatgttctagataaaaatcatgtggcagacattgataaattaattgactatgctgcctcaggggatccaacatcaccagataacattgaatcccctaatgcaccatgggtttttgcatgtgcacctgaccgatgtccaccaacttgtatttatgtcgcaggaatggcagaacttggtgcatttttttcaatcctgcaggatatgagaaatactataatggcctcaaagaccgtaggcacagctgaagagaaacttaagaaaaagtcttcattctatcaatcttatttacggcggacacagtcaatgggaatccagcttgatcagaggattattctcttgtatatgcttgaatggggaaaagagatggttgaccactttcatctgggtgatgatatggatcctgagctaagaggtcttgcccaggcactgattgatcagaaggtaaaggaaatatctaatcaggatccacttaagatatga

SEQ ID NO: 2748 - RNA, 1302 nt, synthetic construct
  misc_feature 1..1302: note = derived and/or modified CDS sequence (wt) from PUUV(Palbole_98-2)__AM746328.1__N
  source 1..1302: mol_type = other RNA
atgagtgatttgacagatatccaagaggatataacccgccatgaacaacagcttgttgttgccaggcaaaaacttaaggatgcagagaaggcagtggaaatggacccggatgacgttaacaaaaacacactgcaagcaaggcaacagacagtgtcagcactggaggataaactcgcagacttcaagcgaagaatggcagatgctgtgtccaggaagaagatggatacaaagcctactgatccaactgggattgagccagatgaccacctcaaggagcgatcaagcctgcgatatggaaatgtccttgatgtgaatgccattgatatagaagagccaagcggccaaacagcagattggtatacaattggagtgtatgtaatagggttcacactacctattattttgaaagccctatacatgctttccacacgtgggagacaaactgtaaaggagaataaagggacacgcatcagattcaaggatgacacttcatttgaggatatcaatggtatcagacgaccaaaacacctctatgtatccatgcctacagcccagtctaccatgaaagcagaagaacttacaccaggtcggttccgcacaatagtctgtggcttattccctacacaaattcaagtccgaaatataatgagtccagtaatgggagtgattggcttttctttcttcgttaaggattgggcagacaggatacgggagttcatggaaaaggagtgcccatttataaagccagaggttaaaccagggacaccaacacaagagattgaattcttaaagaaaaataaagtttactttatggaccgccaaaatgttctagataaaaatcatgtggctgacattgataaattaattgactatgctgcctcgggggatccaacatcaccagataacattgaatcccctaatgcaccatgggtttttgcatgtgcacctgaccgatgtccaccaacttgtatttatgttgcaggaatggcagaacttggagcatttttttcaatactgcaagatatgagaaatactataatggcctcaaagaccgtgggcacagctgaagagaagcttaagaaaaagtcttccttctatcagtcttatttacggcggacacagtcaatgggaattcagcttgatcagaggattattctcttgtatatgcttgaatggggaaaagagatggttgaccactttcatttgggtgatgacatggatcctgaactcagaggttttgctcaggcactgatcgatcagaaggtaaaagagatatctaatcaggatccacttaagatatga

SEQ ID NO: 2749 - RNA, 1302 nt, synthetic construct
  misc_feature 1..1302: note = derived and/or modified CDS sequence (wt) from PUUV(Palbole_98-3)__AM746329.1__N
  source 1..1302: mol_type = other RNA
atgagtgatttgacagatatccaagaggatataacccgccatgaacaacagcttgttgttgccaggcaaaaacttaaggatgcagagaaggcagtggaaatggacccggatgacgttaacaaaaacacactgcaagcaaggcaacagacagtgtcagcactggaggataaactcgcagacttcaagcgaagaatggcagatgctgtgtccaggaagaagatggatacaaagcctactgatccaactgggattgagccagatgaccacctcaaggagcgatcaagcctgcgatatggaaatgtccttgatgtgaatgccattgatatagaagagccaagcggccaaacagcagattggtatacaattggagtgtatgtaatagggttcacactacctattattttgaaagccctatacatgctttccacacgtgggagacaaactgtaaaggagaataaagggacacgcatcagattcaaggatgacacttcatttgaggatatcaatggtatcagacgaccaaaacacctctatgtatccatgcctacagcccagtctaccatgaaagcagaagaacttacaccaggtcggttccgcacaatagtctgtggcttattccctacacaaattcaagtccgaaatataatgagtccagtaatgggagtgattggcttttctttctttgttaaggattgggcagacaggatacgggagttcatggaaaaggagtgcccatttataaagccagaggttaaaccagggacaccaacacaggagattgaattcttaaagaaaaataaagtttactttatggaccgccaaaatgttctagataaaaatcatgtggctgacattgataaattaattgactatgctgcctcgggggatccaacatcaccagatagcattgaatcccctaatgcaccatgggtttttgcatgtgcacctgaccgatgtccaccaacttgtatttatgttgcaggaatggcagaacttggagcatttttttcgatactgcaagatatgagaaatactataatggcctcaaagaccgtgggtacagctgaagagaagcttaagaaaaagtcttccttctatcagtcttatttacggcgaacacagtcaatgggaattcagcttgatcagaggattattctcttgtatatgcttgaatggggaaaagagatggttgaccactttcatttgggtgatgacatggatcctgaactcagaggtcttgctcaggcactgattgatcagaaggtaaaagagatatctaatcaggacccacttaagatatga

SEQ ID NO: 2750 - RNA, 1302 nt, synthetic construct
  misc_feature 1..1302: note = derived and/or modified CDS sequence (wt) from PUUV(PUUV/Ardennes/Mg156/2011)__KT247592.1__N
  source 1..1302: mol_type = other RNA
atgagtgacttgacagacattcaggaggatataacccgccatgaacaacaacttgttgttgccagacagaaactcaaggatgcagaaaaggcagtggagatggacccagatgacgttaacaaaaacacactgcaagcaaggcaacagacagtgtcagcactggaggacaaacttgcagacttcaagcgacagatggcagatgctgtgtccaggaaaaaaatggatactaaacctactgacccgactgggattgagcctgatgaccatctcaaggagcgatcaagcctcagatatgggaatgtccttgatgtaaatgctattgatatagaagaaccaagtggtcaaacagcagactggtatacaattggagtgtatgttataggcttcacacttcctattatcctgaaggctttatatatgttgtcaacacgtgggagacaaactgtgaaagaaaacaaagggactcgtatccgtttcaaagatgacacttccttcgaggacatcaatggtatcaggagaccaaagcatctatatgtttccatgcctactgctcaatcaactatgaaggctgaagaattaacccctgggcgatttagaaccatagtatgtggtctatttccaactcaaattcaagtacgcaacataatgagccctgtaatgggagtcattggtttttctttttttgtcaaggactgggcagatcggattagggaattcatggaaaaagagtgcccttttatcaaaccagaggtgaagccaggaacaccagcccaggaagttgaattcctaaagaggaacaaaatatactttatgcagaggcaggacgtactggataaaaaccatgttgctgatattgataagttgattgactatgcagcctcaggagatccaacatcaccagataatattgaagccccaaatgcaccctgggtatttgcctgtgcacctgaccggtgcccaccgacatgtatttatgttgcagggatggctgaattaggtgcattcttttccatattacaggatatgagaaataccatcatggcatcaaaaactgttggaacagcagaagaaaagttaaaaaagaaatcatcattttatcaatcctacctgcggaggactcaatccatgggaatacagcttgaccaaagaattatcttattatatatgcttgaatggggcaaagagatggtggatcatttccaccttggcgatgatatggatcctgaacttaggggccttgctcaggctcttattgatcaaaaagtgaaggaaatctccaaccaggagcccttgaagatatga

SEQ ID NO: 2751 - RNA, 1302 nt, synthetic construct
  misc_feature 1..1302: note = derived and/or modified CDS sequence (wt) from PUUV(PUUV/Jelgava/Mg136/2008)__JN657230.1__N
  source 1..1302: mol_type = other RNA
atgagtgacttggcagatatccaagaggatataacccgccatgagcagcaacttgttgttgccagacagaaactcaaggatgcggagagagcagtggaagtggacccagatgacgttaacaagaacacactacaagcaaggcaacaaacagtgtcagcactggaggataagctcgcagactacaagagaaggatggcagatgctgtgtcccggaagaaaatggatactaaacctgctgacccgactgggattgaacctgatgaccatctcaaggaaagatcaagccttagatatggaaatgttcttgatgtaaatgccattgatattgaggagccaagtggtcaaacagcagactggtataccataggggtctatgtgataggttttacactacccatcatcctaaaggcattgtacatgttgtcaacacgtgggaggcaaactgtaaaagaaaataaagggacaaggataagatttaaagatgatacatccttcgaggatattaacggcattaggagaccaaaacacctgtatgtctctatgcccacagcccaatccacaatgaaggcagaagaactcacacctgggcggttccgtacagtagtatgtggcctattccctacccaaatacaagtacgcaacatcatgagtccggtgatgggggtcattggcttttcgttctttgtcaaagactggccagatagaatcaaagagttcatggagaaggaaagcccttttataaaaccagatgttaaaccaggaacaccagcacaggaggtagaatttctaaagaggaataaagtatactttatgaaccgtcaggatgtcctcgataagaaccatgtggctgacatcgataaactaattgattatgctgcctctggagatcctacatcacctgatgacatagaatctcctaatgcaccatgggtgtttgcctgtgcaccagatcggtgccctccaacatgcatttatgttgcagggatggcagagctgggtgcatttttctctattttgcaggatatgagaaataccattatggcctctaagactgtaggaacagctgaagagaaactgaagaaaaaatcctcattttaccagtcatatttgcgccggacacaatcaatggggattcaacttgatcaaaggataatccttctatacatgttggagtggggaaaagaaatggtggaccacttccaccttggtgatgatatggatcctgaactcaggggtcttgcccaggcattgattgatcagaaagtgaaagagatatcaaatcaagagcccttaaagatatga

SEQ ID NO: 2752 - RNA, 1302 nt, synthetic construct
  misc_feature 1..1302: note = derived and/or modified CDS sequence (wt) from PUUV(PUUV/Jelgava/Mg140/2008)__JN657231.1__N
  source 1..1302: mol_type = other RNA
atgagtgacttggcagatatccaagaggatataacccgccatgagcagcaacttgttgttgccagacagaaactcaaggatgcagagagagcagtggaagtggacccagatgacgttaacaagaacacactacaagcaaggcaacaaacagtgtcagcactggaggataagctcgcagactacaagagaaggatggcagatgctgtgtcccggaagaaaatggatactaaacctgctgacccgactgggattgaacctgatgaccatctcaaggaaagatcaagccttagatatggaaatgttcttgatgtaaatgccattgatattgaggagccaagtggtcaaacagcagactggtataccataggggtctatgtgataggttttacactacccatcatcctaaaggcattgtacatgttgtcaacacgtgggaggcaaactgtaaaagaaaataaagggacaaggataagatttaaagatgatacatccttcgaggatattaacggcattaggagaccaaaacacctgtatgtctctatgcccacagcccaatccacaatgaaggcagaagaactcacacctgggcggttccgtacagtagtatgtggcctattccatacccaaatacaagtacgcaacatcatgagtccggtgatgggggtcattggcttttcgttctttgtcaaagactggccagatagaatcaaagagttcatggagaaggaatgcccttttataaaaccagatgttaaaccaggaacaccagcacaggaggtagaatttctaaagaggaataaagtatactttatgaaccgtcaggatgtcctcgataagaaccatgtggctgacatcgataaactaattgattatgctgcctctggagatcctacatcacctgatgacatagaatctcctaatgcaccatgggtgtttgcctgtgcaccagatcggtgccctccaacatgcatttatgttgcagggatggcagagctgggtgcatttttctctattttgcaggatatgagaaataccattatggcctctaagactgtaggaacagctgaagagaaactgaagaaaaaatcctcattttaccagtcatatttgcgccggacacaatcaatggggattcaacttgatcaaaggataatccttctatacatgttggagtggggaaaagaaatggtggaccacttccaccttggtgatgatatggatcctgaactcaggggtcttgcccaggcattgattgatcagaaagtgaaagagatatcaaatcaagagcccttaaagatatga

SEQ ID NO: 2753 - RNA, 1302 nt, synthetic construct
  misc_feature 1..1302: note = derived and/or modified CDS sequence (wt) from PUUV(PUUV/Jura/Mg2/2010)__KT247596.2__N
  source 1..1302: mol_type = other RNA
atgagtgacttgacagacattcaagaggatataacccgccatgaacaacaacttgttgttgccagacagaaactcaaggatgcagaaaaggcggtggagatggacccagatgacgttaacaaaaacacactgcaagcaaggcaacagacagtgtcagcattggaagacaaacttgcagacttcaagagaagaatggcagatgctgtgtccaggaaaaagatggatactaaacctactgacccgactgggattgaacctgatgaccacctcaaggagcgatcaagtcttaggtatggaaatgtccttgatgtgaatgctatcgacatagaagaaccaagtggccaaacagcagattggtatacaattggggtatatgttataggctttacactccctatcatcttgaaggccttatacatgttatcaacacgtgggagacagactgtaaaggaaaataagggaacccgcattcgatttaaggatgacacttcatttgaggacataaacggcattagaagaccaaagcacttgtatgtatccatgcctacagcacaatctaccatgaaagcagaggagttaactcctggacgatttaggaccatagtatgtggtctttttccaactcaaattcaagtgcgaaatataatgagtcctgtgatgggagtcatcgggttttcattttttgttaaggattgggcagaccggattagggaatttatggagaaggagtgcccctttattaaaccagagataaaaccgggaacaccagctcaggaagctgaattcttaaagaggaataagatatactttatgcagcgtcaagatgtattggataaaaatcatgtagctgacattgataagctgattgattatgcagcctcaggagatcctacatcacccgataatattgagtctcctaatgcaccctgggtgtttgcctgtgcccctgatcgatgcccaccaacatgcatttatgttgcaggaatggcagaactaggtgcatttttttctatattacaggatatgaggaataccatcatggcgtccaaaactgttggcacagctgaagaaaaattaaagaagaagtcatcattttaccagtcatacctgcgaaggacccaatcaatgggaatacagctggaccagaggatcatcttactgtatatgcttgaatggggtaaggaaatggtggaccactttcatctgggtgacgatatggatcctgagcttaggggccttgcccaagcacttattgatcagaaagtgaaagagatttctaatcaggaacccttaaaaatatga

SEQ ID NO: 2754 - RNA, 1302 nt, synthetic construct
  misc_feature 1..1302: note = derived and/or modified CDS sequence (wt) from PUUV(PUUV/Madona/Mg233/2008)__JN657232.1__N
  source 1..1302: mol_type = other RNA
atgagtgacttggcagatatccaagaggatataacccgccatgagcagcaacttgttgttgcaagacagaagcttaaggatgcagagagagcagtggaagtggacccagatgacgttaacaagaacacactacaagcaaggcaacaaacagtgtcagcactggaggataagctcgcagactacaagagaaggatggcagatgctgtgtcccggaagaaaatggatactaagcctactgacccgactgggattgaacctgatgaccatctcaaggaaagatcaagccttagatatggaaatgtccttgatgtaaatgccattgatattgaagaaccgagtggtcaaacagcagactggtatactataggggtttatgtgataagttttacattacccatcatcctaaaggcattgtacatgttgtcaacacgtgggaggcaaactgtaaaggaaaacaaagggacaaggataaggtttaaggatgatacatctttcgaggacattaatggtattaggagacccaaacatctgtatgtttctatgcctacagctcaatccacaatgaaggcagaagaactcacacctgggcggttccgtacaatagtatgtggcctattccctacccaaatacaagtacgcaacatcatgagtccagtaatgggggtcattggcttttcgttctttgttaaagactggccagatagaatcaaagaatttatggagaaggaatgccctttcataaaaccagatgtcaaaccaggaacaccagcacaggagatagaatttctaaagaggaataaagtatactttatgaaccgtcaggatgtccttgataagaaccatgtggctgacatcgataaactaattgactatgctgcctctggagatcccacatcacctgatgacatagaatctcctaatgcaccatgggtgtttgcctgtgcaccagatcggtgtccaccaacatgcatttatgttgcagggatggcagagttaggtgcatttttctctattttgcaggatatgagaaacaccattatggcctccaagactgtaggaacagctgaagagaaactgaagaaaaaatcctcattctaccaatcatacctgcgccggacacaatcgatggggattcaacttgatcaacggataatccttctatacatgttggaatgggggaaagaaatggtggaccacttccatcttggtgatgatatggatcctgaacttaggggtcttgctcaggcattgattgatcagaaagtaaaagagatatcaaatcaagagcccttaaaaatataa

SEQ ID NO: 2755 - RNA, 1302 nt, synthetic construct
  misc_feature 1..1302: note = derived and/or modified CDS sequence (wt) from PUUV(PUUV/Orleans/Mg23/2010)__KT247594.1__N
  source 1..1302: mol_type = other RNA
atgagtgacttaacagatatccaggaggttataacccgccatgaacaacaacttgttgttgcaagacaaaagctcaaggatgcagagaaggcggtggaaatggacccagatgacgttaacaaaaacacacttcaagcaaggcaacagacagtgtcagcattggaggacaaacttgcagacttcaagcgaagaatggcagatgctgtgtccaggaaaaagatggatactaagcctgctgacccgactgggattgaacctgatgaccatctcaaggagcgatcaagccttaggtatggaaatgtccttgatgtgaacgccattgatattgaagaaccaagcggccaaacagcagattggtatacaattggagtctatgttataggctttacactccctattatcctaaaggccctgtacatgctttcaacacgagggaggcaaactgtgaaagaaaacaagggaactcgtattcgatttaaagatgatacatcttttgaagatatcaatggtattcgcaggccaaagcacctatatgtgtccatgcctactgcccaatcaactatgaaggctgaagagctgactcctgggcggtttaggaccatagtgtgtggtctttttccaacccagatccaagtgcgtaatataatgagtcctgtcatgggggtcataggcttttccttttttgttaaagattgggcagatcggattaaggagttcatggaaaaggaatgtcctttcattaaaccagaagtcaaaccagggacaccagtcaaagaagctgagttcttaaaaaagaacagggtgtacttcatgcaacgccaagatgtacttgataaaaatcatgtagctgacattgataagttaatcgattatgcagccgcaggagatcccacttcacctgataatattgagtcacccaatgcaccttgggtattcgcctgtgcccctgatcgatgccctccaacatgtatttatgttgcagggatggcagaattaggtgcatttttttctatattacaggacatgaggaatactatcatggcatcaaaaactgttggcacagcagaagaaaaattaaaaaagaaatcatcattttatcaatcatacctaagaagaactcagtcaatggggatacagctggaccaaagaatcatcttactatatatgcttgaatggggtaaagagatggtagatcactttcatttgggtgatgatatggatcctgaacttagaggccttgcccaagcactgattgatcagaaagttaaagaaatatcaaaccaggagcccctaaaaatatga

SEQ ID NO: 2756 - RNA, 1302 nt, synthetic construct
  misc_feature 1..1302: note = derived and/or modified CDS sequence (wt) from PUUV(Tobetsu-60Cr-93)__AB010731.1__N
  source 1..1302: mol_type = other RNA
atgagtgacttgaaagatatccaggaggatataacccgccatgaacaacaacttgttgttgcccggcaaaagcttagagatgcagagaaagcagtggaaatggacccagatgacgttaacaagaacacactgcaagcacggcaacaaacagtgtcagcattggaagataaacttgcagacttcaagcgaagaatggcagatgttgtgtccaggaaaaagatggatactaagcctgctgacccgactgggattgaacctgatgaccacctcaaggatagatctagcctcagatatgggaatgtccttgatgtgaatgcaattgacatagaagagcctagtggtcaaacagcagattggtataccataggagtatatataatagggtttacactacctattattctaaaggcactttatatgttgtcaacccgaggacgtcaaactgtgaaagagaacaaagggacaaggatccgatttaaggatgatacatcatttgaagacatcaatgggattaggaggccaaaacatctgtatgtgtctatgcccacagctcaatcaacaatgaaggctgaagagatcacacctgggaggttccgcaccatagtctgtggccttttcccgacacaaattcaagttcggaatataatgagtcctgtcatgggggttattggattctcattctttgtaaaagactggcctgagcgaattaaagaattcatggagaaggagtgcccattcataaaaccagaggtgaagccagggaccccagcaaaagaggtggagattttaaaaagaaataaagtttacttcatgcaacggcaagatgtgcttgataagaatcatgtccccgacatcgataaactaattgactatgcagcctctggagatcctacgtcacctgacaatattgactccccaaatgccccatgggtatttgcatgtgcccctgataggtgcccaccaacatgtatctatgttgcaggaatggcagagttaggagcgttcttttctatcctgcaggatatgaggaacaccataatggcatctaaaactgtagggacagctgaagaaaaactgaagaaaaaatcatctttctaccaatcatatttaaggcgtactcaatcaatggggatccaacttgaccaaaggataatcctgttatacatgcttgagtggggaaaagagatggtggatcactttcatctcggggatgatatggatcctgagcttagagggctggcgcaggcattgattgatcagaaagtaaaggaaatttcgaaccaggagccactaaagatatga

SEQ ID NO: 2757 - RNA, 1302 nt, synthetic construct
  misc_feature 1..1302: note = derived and/or modified CDS sequence (wt) from PUUV(Vranica)__U14137.1__N
  source 1..1302: mol_type = other RNA
atgagtgatctgacagatatccaagaggatataacccgccatgaacaacagcttgttgttgccaggcaaaaacttaaggatgcagagaaggcagtggaaatgtacccggatgacgttaacaaaaacacactgcaagcaaggcaacagacagtgtcagcactggaggataaactcgcagacttcaagcgaagaatggcagatgctgtgtccaggaaaaagatggatacaaagcctactgatccaactgggattgagccagatgaccacctcaaggagagatcaagcctgcgatatggaaatgtccttgatgtgaatgccattgatatagaagagccgagtggccaaacagcagattggtatacaattggagtgtatgtaatagggttcacactgcctattattttgaaagccctatacatgctttccacacgcgggagacaaactgtgaaggagaataaagggacacggtatcgatttaaggatgatacttcatttgaggacatcaatggcatcagacgaccaaagcacctctatgtatccatgcctacagcccaatctaccatgaaggcagaagaacttacaccaggtcgattccgcacaatagtctgtggcttattccctacacaaattcaagttcgaaatataatgagtccagtaatgggagtaattggcttctctttctttgttaaggactgggcagacaggatacgagagttcatggaaaaggaatgtccatttataaagccagaggttaaaccagggacaccaacacaagagattgaattcttaaagaaaaataaagtttactttatggaccgccaaaatgttctagataaaaatcatgtggctgatattgataaattaattgattatgctgcctcaggggatccaacatcaccagataatattgaatcccctaatgcaccatgggtctttgcatgtgcacctgaccgatgtccaccaacttgtatttatgtcgcaggaatggcagaacttggtgcatttttttcaatcctgcaggatatgagaaatactataatggcctcaaagaccgtgggcacagctgaagaaaagcttaagaaaaaatcttcattctatcagtcttatttacggcggacacagtcaatgggaatccagcttgatcagaggattattctcttatatatgcttgaatggggaaaagagatggttgaccactttcatctgggtgatgacatggatcctgagctcagaggtcttgcccaggcactgattgatcagaaggtaaaagaaatatctaatcaggatccacttaagatatag

SEQ ID NO: 2758 - RNA, 1302 nt, synthetic construct
  misc_feature 1..1302: note = derived and/or modified CDS sequence (wt) from PUUV(P360)__L11347.1__N
  source 1..1302: mol_type = other RNA
atgagtgacttgacagacatccaagaggagataacccgccatgagcaacaacttgttgttgccagacaaaaactcaaggatgcagagagagcagtggaagtgtacccggatgacgttaacaagaacacattacaagcaagacaacaaacagtgtcagcactggaggataaactcgcagactacaagagaagaatggcagatgctgtgtcccggaagaaaatggatactaaacctactgacccgactgggattgaacctgatgatcatctcaaggagagatcaagccttagatatggaaatgtccttgatgtgaatgctattgacattgaagaaccaagtggccagacagcagattggtatactatcggagtctatgtaatagggttcacaattcctatcattttgaaggctctatatatgttgtcaacacgtggaagacagactgtaaaggaaaacaaaggaacacggatcaggttcaaggatgacacatcatttgaggatatcaatggcatcaggagaccaaaacacctatatgtatccatgcctactgcccagtccaccatgaaagctgaagaacttacacctggacggttccgtacaatagtatgtggcttattccctacacagatacaagttcgtaacatcatgagtccagtaatgggagtgattggtttttctttcttcgttaaagactggccagaaaaaattagggagtttatggagaaagaatgccctttcataaagccagaagttaaacctgggacaccagcacaggaggtagaatttttgaaaagaaatagagtttatttcatgacccgccaggatgttcttgacaaaaatcatgtggctgacatcgataagttgattgactatgctgcctctggtgaccctacatcgcctgatgacatcgaatctcctaatgcaccatgggtatttgcttgtgcaccagatcggtgccccccaacatgtatttatgttgctgggatggctgaattaggtgcattcttttccatcttacaggatatgaggaacaccattatggcatctaaaactgtgggcacagcagaagagaaactgaaaaagaagtcctccttctatcaatcatatttgcgccgaacacaatcaatggggattcaacttgatcagaggataatcctactgtacatgttggaatggggaaaagaaatggtggatcatttccatcttggtgatgacatggatcctgagctaaggggccttgctcagtcactcatagaccagaaggtaaaagagatatcaaaccaagaacccttaaagatatga

SEQ ID NO: 2759 - RNA, 1302 nt, synthetic construct
  misc_feature 1..1302: note = derived and/or modified CDS sequence (wt) from PUUV(Aijajarvi/Mg7/05)__GQ339476.1__N
  source 1..1302: mol_type = other RNA
atgagtgacttgacagatattcaagaggatataactcgccatgaacaacagcttgttgttgccagacaaaaacttaaggatgcagaaaaggcagtggagatggacccggatgacgttaacaaaaacacactgcaagcaaggcaacaaacagtgtcagcactggaggataaactcgcagacttcaagcgacagatggcagatgctgtgtccaggaagaaaatggatactaagcctactgacccaactgggattgagccagatgaccacctcaaggaaagatcaagcctgcgatatggaaatgtccttgatgtgaatgctattgacatagaagagccaagtggccagacagcagattggtatactattggagtatatgtaatagggttcacactacctattattttaaaggccctttacatgctatcaacacgtggaaggcaaactgttaaggagaacaaaggaacacgcatccgcttcaaagatgatacttcatttgaggacattaatggtatcagacgaccaaaacacctttatgtgtccatgcctactgctcagtccactatgaaagcagaagaacttacaccgggtcggttccgtacaatagtttgtgggttatttccaacacagatccaagtgcgaaatataatgagtccagtaatgggggtgattggcttttctttctttgttaaaggttgggcagacaggatcagagagttcatggaaaaggagtgcccgtttataaagccagaggtcaagccaggaacaccaacacaggaggttgaattcttgaagaaaaataaagtttacttcctagaccgccaaaatgttctggataaaaatcatgtagctgacattgataagttgatagactatgctgcctcaggagatccaacatcaccagataacattgaatctcctaatgcaccatgggtttttgcatgtgctcctgatcggtgcccaccaacctgtatctatgttgcaggaatggcagaactcggtgcattcttttcgattttgcaggatatgaggaacactataatggcctcaaagactgttggcacggcagaagagaagctaaagaaaaaatcttcattctatcaatcttacttgcgacggacacaatcaatgggaatccaacttgaccagaggattattctcttgtttatgttagaatggggaaaagaaatggttgatcactttcacttgggtgatgacatggatcctgagcttagaggtcttgcccaggcactgattgatcaaaaggtgaaggagatctctaatcaggaaccattgaaaatatag

SEQ ID NO: 2760 - RNA, 1302 nt, synthetic construct
  misc_feature 1..1302: note = derived and/or modified CDS sequence (wt) from PUUV(Bavaria 151/05)__EU439968.1__N
  source 1..1302: mol_type = other RNA
atgagtgacttgacagacattcaggaggatataacccgccatgaacaacaacttgttgttgccagacaaaagctcaaggatgcagaaaaggcggtggaaatggacccagatgacgttaacaagaatacattacaagcaaggcaacaaacagtgtcagcactggaagataaactcgcagattacaagcgaagaatggcagatgctgtgtcccggaaaaagatggatactaagcctactgatccgactgggattgaaccagatgaccatctcaaagaacgatcaagccttaggtatggaaatgtccttgatgtgaacgctattgacatagaagaaccaagtggtcaaacagcagattggtatacaattggggtttatgtcataggtttcacactccctatcatcttgaaggccttgtatatgttatcaacccgtgggagacagactgtgaaggagaacaaagggactcgaattcggtttaaagatgatacctcatttgaggacattaatggcattaggagaccaaagcatttgtatgtgtccatgcccactgctcagtcaactatgaaagctgaagaattaacccctggtaggttcaggaccatagtctgcggtttatttccaactcagattcaagtacgtaatataatgagtcctgtgatgggagtcatcggtttttctttttttgtaaaggactgggcagaacgtattagggaatttatggagaaagaatgccccttcctcaaaccagaaataaaaccagggacaccagcacaggaggctgaattcttgaagaaaaataaagtttattttatgcaacgccaagatgtattggacaaaaatcatgtggctgatattgataagttaattgattatgcagcctcaggagatcccacatcacctgacaacattgagtctcctaatgccccatgggtatttgcatgtgcccctgacagatgcccaccaacttgtatttatgttgcaggaatggcagagttaggtgcctttttctccatattgcaggatatgagaaacactattatggcatctaaaactgttggcacagctgaggaaaaactgaaaaagaagtcatcattttatcaatcatatctacgtagaactcagtcaatgggaatacaactggaccaaagaattattctcttgtatatgcttgaatggggtaaggagatggtagatcattttcatcttggtgatgacatggatccagaacttagaggccttgcacaagcacttattgatcaaaaagtaaaagaaatatccaatcaggagcccttgaaaatatga

SEQ ID NO: 2761 - RNA, 1302 nt, synthetic construct
  misc_feature 1..1302: note = derived and/or modified CDS sequence (wt) from PUUV(Bavaria 159/05)__EU439972.1__N
  source 1..1302: mol_type = other RNA
atgagtgatttgacagacattcacgaggatataacccgccatgaacaacaacttgttgttgccagacaaaagctcaaggatgcagaaaaggcggtggaaatggacccagatgacgttaacaagaatacattacaagcaaggcaacaaacagtgtcagcactggaagataaactcgcagattacaagcgaagaatggcagatgctgtgtcccgtaaaaagatggatactaagcctactgatccgactgggattgaaccagatgaccatctcaaagaacgatcaagccttaggtatggaaatgtccttgatgtgaacgctattgacatagaagaaccaagtggtcaaacagcagattggtatacaattggggtttatgtcataggtttcacactccctatcatcttgaaggccttgtatatgttatcaacccgtgggagacagactgtgaaggagaacaaagggactcgaattcggtttaaagatgatacctcatttgaggacattaatggcattaggagaccaaagcatttgtatgtgtccatgcccactgctcagtcaactatgaaagctgaagaattaacccctggtaggttcaggaccatagtctgcggtttatttccaactcagattcaagtacgtaatataatgagtcctgtgatgggagtcatcggtttttctttttttgtaaaggactgggcagaacgtattagggaatttatggagaaagaatgccccttcatcaaaccagaaataaaaccagggacaccagcacaggaggctgaattcttgaagagaaataaagtttattttatgcaacgccaagatgtattggacaaaaatcatgtggctgatattgataagttaattgattatgcagcctcaggagatcccacatcacctgacaacattgagtctcctaatgccccatgggtatttgcatgtgcccctgacagatgcccaccaacttgtatttatgttgcaggaatggcagagttaggtgcctttttctccatattgcaggatatgagaaacaccattatggcatctaaaactgttggcacagctgaggaaaaactgaaaaagaagtcatcattttatcaatcatatctacgtagaactcagtcaatgggaatacaactggaccaaagaattattctcttgtatatgcttgaatggggtaaggagatggtagatcattttcatcttggtgatgacatggatccagaacttagaggccttgcacaagcacttattgatcaaaaagtaaaagaaatatccaatcaggagcccttgaaaatatga

SEQ ID NO: 2762 - RNA, 1299 nt, synthetic construct
  misc_feature 1..1299: note = derived and/or modified CDS sequence (wt) from PUUV(Bavaria CG 33/04)__DQ016430.2__N
  source 1..1299: mol_type = other RNA
atgagtgacttgacagacattcaggaggatataacccgccatgaacaacaacttgttgttgccagacaaaagctcaaggatgcagaaaaggcggtggaaatggacccagatgacgttaacaagaatacattacaagcaaggcaacaaacagtgtcagcactggaagataaactcgcagattacaagcgaagaatggcagatgctgtgtcccggaaaaagatggatactaagcctactgatccgactgggattgaaccagatgaccatctcaaagaacgatcaagccttaggtatggaaatgtccttgatgtgaacgctattgacatagaagaaccaagtggtcaaacagcagattggtatacaattggggtttatgtcataggtttcacactccctatcatcttgaaggccttgtatatgttatcaacccgtgggagacagactgtgaaggagaacaaagggactcgaattcggtttaaagatgatacctcatttgaggacattaatggcattaggagaccaaagcatttgtatgtgtccatgcccactgctcagtcaactatgaaagctgaagaattaacccctggtaggttcaggaccatagtctgcggtttatttccaactcagattcaagtacgtaatataatgagtcctgtgatgggagtcatcggtttttctttttttgtaaaggactgggcagaacgtattagggaatttatggagaaagaatgccccttcatcaaaccagaaataaaaccagggacaccagcacaggaggctgaattcttgaagagaaataaagtttattttatgcaacgccaagatgtattggacaaaaatcatgtggctgatattgataagttaattgattatgcagcctcaggagatcccacatcacctgacaacattgagtctcctaatgccccatgggtatttgcatgtgcccctgacagatgcccaccaacttgtatttatgttgcaggaatggcagagttaggtgctttttccatattgcaggatatgaggaatactattatggcatctaaaactgttggcacagctgaggaaaaactgaaaaagaagtcatcattttatcaatcatatctacgtagaactcagtcaatgggaatacaactggaccaaagaattattctcttgtatatgcttgaatggggtaaggagatggtagatcattttcatcttggtgatgacatggatccagaacttagaggccttgcacaagcacttattgatcaaaaagtaaaagaaatatccaatcaggagcccttgaaaatatga

SEQ ID NO: 2763 - RNA, 1302 nt, synthetic construct
  misc_feature 1..1302: note = derived and/or modified CDS sequence (wt) from PUUV(Bavaria CG 34/04)__AY954723.2__N
  source 1..1302: mol_type = other RNA
atgagtgacttgacagacattcaggaggatataacccgccatgaacaacaacttgttgttgccagacaaaagctcaaggatgcaggaaaggcggtggaaatggacccagatgacgttaataagaacacattacaagcaaggcaacaaacagtgtcagcactggaagacaaactcgcagattacaagagaagaatggcagatgctgtgtcccggaaaaagatggatactaagcctactgatccgactgggattgaaccagatgaccatcttaaagaacgatcaagccttaggtatggaaatgtccttgatgtgaatgctattgacatagaagaaccgagtggtcaaacagcagattggtatacaattggggtttatgtcataggttttacactccctatcatcttgaaggccttgtatatgttatcaacccgtgggagacagactgtgaaggagaataaagggactcgcatccggtttaaagatgatacttcatttgaggacattaatggtattaggagaccaaagcatttgtatgtgtccatgcccactgctcagtcaactatgaaagctgaggaattaacccctggtaggttcaggactatagtctgcggtttatttccaactcaaattcaagtacgtaatataatgagtcctgtgatgggagtcatcggtttttctttttttgtaaaggattgggcagaacgtattagagaatttatggagaaagaatgccccttcatcaaaccagaaatgaaaccagggacaccagcacaggaggctgagttcttaaagagaaataaagtttactttatgcaacgccaagatgtattggacaaaaatcatgtggctgatattgataagttaattgattatgcagcctcaggagatcctacatcacctgacaacattgagtctccaaatgccccatgggtgtttgcatgtgcccctgacagatgcccaccaacttgtatttatgttgcgggaatggcagagttaggtgcctttttctccatattgcaggatatgaggaatactattatggcatctaaaactgttggcacagctgaggaaaagctgaaaaagaagtcatcattttatcaatcatatctacgtagaactcagtcaatgggaatacaactggaccaaagaattattctcttatatatgcttgaatggggtaaggaaatggttgatcattttcatctgggtgatgacatggatccagaacttagaggccttgcacaagcacttattgaccaaaaagtaaaggaaatatccaatcaggagcccttaaaaatatga

SEQ ID NO: 2764 - RNA, 1302 nt, synthetic construct
  misc_feature 1..1302: note = derived and/or modified CDS sequence (wt) from PUUV(Bavaria CG 41/04)__DQ016432.2__N
  source 1..1302: mol_type = other RNA
atgagtgacttgacagacattcaggaggatataacccgccatgaacaacaacttgttgttgccagacaaaagctcaaggatgcagaaaaggcggtggaaatggacccagatgacgttaacaagaacacattacaagcaaggcaacaaacagtgtcagcactggaagacaatctcgcagattacaagagaagaatggcagatgctgtgtcccggaaaaagatggatactaagcctactgatccgactgggattgaacctgatgaccatcttaaagaacgatcaagccttaggtatggaaatgtccttgatgtgaatgctattgacatagaagaaccgagtggtcaaacagcagattggtatacaattggggtttatgtcataggtttcacactccctatcatcttaaaggccttgtatatgttatcaacccgtgggagacagactgtgaaggagaacaaagggactcgcatccggtttaaagatgatacttcatttgaggacattaatggtattaggagaccaaagcatttgtatgtgtccatgcccactgctcagtcaactatgaaagctgaggaattaacccctggtaggttcaggactatagtctgcggtttatttccaactcaaattcaagtacgtaatataatgagtcctgtgatgggagtcatcggtttttctttttttgtaaaggattgggcagaacgtattagagaatttatggagaaagaatgccccttcatcaaaccagaaatgaaaccagggacaccagcacaggaggctgagttcttaaagagaaataaagtttactttatgcaacgccaagatgtattggataaaaatcatgtggctgatattgataagttaattgattatgcagcctcaggagatcctacatcacctgacaacattgagtctcctaatgccccatgggtatttgcatgtgcccctgacagatgcccaccaacttgtatttatgttgcgggaatggcagagttaggtgcctttttctccatattgcaggatatgaggaatactattatggcatctaaaactgttggcacagctgaggaaaaactgaaaaagaagtcatcattttatcaatcatatctacgtagaactcagtcaatgggaatacaactggaccaaagaattattctcttatatatgcttgaatggggtaaggaaatggttgatcattttcatctgggtgatgacatggatccagaacttagaggccttgcacaagcacttattgaccaaaaagtaaaggaaatatccaatcaggagcccttaaaaatatga

SEQ ID NO: 2765 - RNA, 1302 nt, synthetic construct
  misc_feature 1..1302: note = derived and/or modified CDS sequence (wt) from PUUV(Bavaria CG 9/04)__AY954722.2__N
  source 1..1302: mol_type = other RNA
atgagtgacttgacagatattcaggaggatataacccgccatgaacaacaacttgttgttgccagacaaaagctcaaggatgcagaaaaggcggtggaaatggacccagatgacgttaacaagaacacattacaagcaaggcaacaaacagtgtcagcactggaagacaaactcgcagattacaagcgaagaatggcagatgctgtgtcccggaaaaagatggatactaagcctactgatccgactgggattgaaccagatgaccatcttaaagaacgatcaagccttaggtatggaaatgtccttgatgtgaatgctattgacatagaagaaccgagtggtcaaacagcagattggtatacaattggggtttatgtcataggtttcacactccctatcatcttgaaggccttgtatatgttatcaacccgtgggagacagactgtgaaggagaacaaagggactcgcatccggtttaaagatgatacttcatttgaggacattaatggtattaggagaccaaagcatttgtatgtgtccatgcccactgctcagtcaactatgaaagctgaagaattaacccctggtaggttcaggactatagtctgcggtttatttccaactcagattcaagtacgtaatataatgagtcctgtgatgggagtcatcggtttttctttctttgtaaaggactgggcagaacgtattagggaatttatggagaaagaatgccccttcatcaaaccagaaatgaaaccaggaataccagcacaggaggctgagttcttaaagagaaataaagtttactttatgcaacgccaagatgtgttggacaaaaatcatgtggctgatattgataagttaattgattatgcagcctcaggagatcccacatcacctgacaacattgagtctcctaatgccccatgggtatttgcatgtgcccctgacagatgcccaccaacttgtatttatgttgcaggaatggcagagttaggtgcttttttctccatattgcaggatatgagaaacactatcatggcttccaaaactgttggcacagctgaggaaaaactgaaaaagaagtcatcattttatcaatcatatttacgtagaactcagtcaatgggaatacaactggaccaaagaattattctcttgtatatgcttgagtggggtaaggaaatggtagatcattttcatctgggtgatgacatggacccagaacttagaggccttgcacaagcacttattgaccaaaaagtgaaggaaatatctaatcaggagcccttgaaaatatga

SEQ ID NO: 2766 - RNA, 1302 nt, synthetic construct
  misc_feature 1..1302: note = derived and/or modified CDS sequence (wt) from PUUV(Bergsjobo/Mg25/05)__GQ339483.1__N
  source 1..1302: mol_type = other RNA
atgagtgacttggcagatatccaggacgagataacccgccatgaacagcaacttgttgctgccagacaaaaactcaaggatgcagagagagcagtggaggtggacccagatgacgttaacaagaacacactgcaagcaaggcaacagacagtgtcagcactggaggataaactcgcagatttcaaacgaagaatggcagatgctgtgtcccggaaaaaaatggatactaaacctactgacccgactgggattgagcctgatgatcacctcaaggaaagatcaagcctcagatatggaaatgtccttgatgtgaatgccattgatattgaagaaccaagtggccaaactgcagattggtatactattggagtttatgtgataggctttacactccctattatcttaaaggcactttatatgttgtcaacacgtgggagacagacagtgaaagaaaacaagggaacaaggattagatttaaggatgacacctcatttgaagatatcaatggcatcagaagacctaaacatttatatgtgtccatgcctacagcacagtccacaatgaaagcagaagagttaacaccaggccggtttcgaacaatagtatgtggtctatttcctactcagattcaagtacgcaatataatgagtccagtcatgggggttattggcttttctttctttgtcaaggattgggcagaaaggattagagaatttatggaaaaagaatgtccttttataaaaccggaagtgaaacctggaacaccagcacaggaggttgaattcctaaagaaaaataagatctattttatgcagcgccaagatgtgcttgacaaaaatcatgtggctgacatcgataagttgattgattatgctgcctcaggagaccctacatcaccagataatatagagtctccaaatgcaccatgggtttttgcctgtgctccagatcgatgtccgcctacatgcatttatgttgcaggtatggcagagcttggtgccttcttttcaatcttgcaggatatgaggaatacaataatggcatctaagactgtaggaacagcagaggaaaagctaaagaaaaaatcatccttttaccaatcctatctgcgacggactcaatccatgggaatccaacttgaccaaaggattattcttttgtatatgcttgaatggggcaaagagatggtggatcatttccatctaggagatgatatggacccagagctgagaggcttagcccaagcactgatagaccagaaggtaaaagaaatatctaaccaggagcctttgaagatttag

SEQ ID NO: 2767 - RNA, 1302 nt, synthetic construct
  misc_feature 1..1302: note = derived and/or modified CDS sequence (wt) from PUUV(CG14444)__AJ277075.1__N
  source 1..1302: mol_type = other RNA
atgagtgacttgacagacattcaggaggatataacccgtcatgaacaacaacttgttgttgccagacagaaactcaaggatgcagaaaaggcggtggagatggacccagatgacgttaacaaaaacacattgcaagcaaggcaacagacagtgtcagcactggaggacaaacttgcagacttcaagcgacaaatggcagatgctgtgtccaggaaaaaaatggatactaaacctactgacccgactgggattgagcctgatgaccatctcaaggagcgatcaagcctcagatatggaaatgtccttgatgtaaatgccattgatatagaagaaccaagtggtcaaacagcagactggtatacaattggagtgtatgttataggcttcacacttcctattatcctgaaggctctatatatgttgtcaacacgtgggagacaaactgtgaaagaaaacaaagggactcgtatccgttttaaagatgacacttccttcgaggacattaatggtatcaggagaccgaagcacctatatgtttccatgcctactgctcaatcaactatgaaggctgaagaactgacccctgggcgatttagaaccatagtatgcggtctatttccgactcaaattcaagtacgcaacataatgagccctgtaatgggagtcattggtttttccttttttgtcaaggactgggcagatcggattagggaattcatggaaaaagagtgcccttttatcaaaccagaggtgaagccaggaacaccagcccaggaagctgaattcctaaagaggaacaaaatatactttatgcagaggcaggaagtactggataaaaaccatgttgctgatattgacaagttaattgactatgcagcctcaggagatccaacatcaccagataatattgaagccccaaatgcaccctgggtgtttgcctgtgcacctgaccggtgcccaccgacatgtatttatgttgcagggatggctgaattaggtgcattcttttccatattacaggatatgagaaatactatcatggcatctaaaactgttggaacagcagaagaaaagttaaaaaagaaatcatcattttatcaatcatacctgcggaggactcaatcaatgggaatacagcttgaccaaagaattatcttactgtatatgcttgaatggggcaaagaaatggtggatcatttccaccttggcgatgatatggatcctgaacttaggggccttgcacaggcacttattgatcaaaaagtgaaggaaatctccaaccaggagcccttaaagatatga

SEQ ID NO: 2768 - RNA, 1302 nt, synthetic construct
  misc_feature 1..1302: note = derived and/or modified CDS sequence (wt) from PUUV(CG14445)__AJ277076.1__N
  source 1..1302: mol_type = other RNA
atgagtgacttgacagacattcaggaggatataacccgtcatgaacaacaacttgttgttgccagacagaaactcaaggatgcagaaaaggcggtggagatggacccagatgacgttaacaaaaacacattgcaagcaaggcaacagacagtgtcagcactggaggacaaacttgcagacttcaagcgacaaatggcagatgctgtgtccaggaaaaaaatggatactaaacctactgacccgactgggattgagcctgatgaccatctcaaggagcgatcgagcctcagatatggaaatgtccttgatgtaaatgccattgatatagaagaaccaagtggtcaaacagcagactggtatacaattggagtgtatgttataggcttcacacttcctattatcctgaaggctctatatatgttgtcaacacgtgggagacaaactgtgaaagaaaacaaagggactcgtatccgttttaaagatgacacttccttcgaggacattaatggtatcaggagaccaaagcacctatatgtttccatgcctactgctcaatcaactatgaaggctgaagaactgacccctgggcgatttagaaccatagtatgcggtctatttccgactcaaattcaagtacgcaacataatgagccctgtaatgggagtcattggtttttccttttttgtcaaggactgggcagatcggattagggaattcatggaaaaggagtgcccttttatcaaaccagaggtgaagccaggaacaccagcccaggaagctgaattcctaaagaggaacataatatactttatgcagaggcaggaagtactggataaaaaccatgttgctgatattgacaagttaattgactatgcagcctcaggagatccaacatcaccagataatattgaagccccaaatgcaccctgggtgtttgcctgtgcacctgaccggtgcccaccgacatgtatttatgttgcagggatggctgaattaggtgcattcttttccatattacaggatatgagaaatactatcatggcatctaaaactgttggaacagcagaagaaaagttaaaaaagaaatcatcattttatcaatcatacctgcggaggactcaatcaatgggaatacagcttgaccaaagaattatcttactgtatatgcttgaatggggcaaagaaatggtggatcatttccaccttggcgatgatatggatcctgaacttaggggccttgcacaggcacttattgatcaaaaagtgaaggaaatctccaaccaggagcccttaaagatatga

SEQ ID NO: 2769 - RNA, 1302 nt, synthetic construct
  misc_feature 1..1302: note = derived and/or modified CDS sequence (wt) from PUUV(CG1820/POR)__KT885052.1__N
  source 1..1302: mol_type = other RNA
atgagtgacttgacagacatccaagaggagataacccgccatgagcaacaacttgttgttgccagacaaaaactcaaggatgcagagagagcagtggaagtggacccggatgacgttaacaagagcacattacaagcaagacaacaaacagtgtcagcactggaggataaactcgcagactacaagagaagaatggcagatgctgtgtcccggaagaaaatggatactaaacctactgacccgactgggattgaacctgatgatcatctcaaggagagatcaagccttagatatggaaatgtccttgatgtgaatgctattgacattgaagaaccaagtggccagacagcagattggtatactatcggagtctatgtaatagggttcacaattcctatcattttgaaggctctatatatgttgtcaacacgtggaagacagactgtaaaggaaaacaaaggaacacggatcaggttcaaggatgacacatcatttgaggatatcaatggcatcaggagaccaaaacacctatatgtatccatgcctactgcccagtccaccatgaaagctgaagaacttacacctggacggttccgtacaatagtatgtggcttattccctacacagatacaagttcgtaacatcatgagtccagtaatgggagtgattggtttttctttcttcgttaaagactggccagaaaaaattagggagtttatggagaaagaatgccctttcataaagccagaagttaaacctgggacaccagcacaggaggtagaatttttgaaaagaaatagagtttatttcatgacccgccaggatgttcttgacaaaaatcatgtggctgacatcgataagttgattgactatgctgcctctggtgaccctacatcgcctgatgacatcgaatctcctaatgcaccatgggtatttgcttgtgcaccagatcggtgccccccaacatgtatttatgttgctgggatggctgaattaggtgcattcttttccatcttacaggatatgaggaacaccattatggcatctaaaactgtgggcacagcagaagagaaactgaaaaagaagtcctccttctatcaatcatatttgcgccgaacacaatcaatggggattcaacttgatcagaggataatcctactgtacatgttggaatggggaaaagaaatggtggatcatttccatcttggtgatgacatggatcctgagctaaggggccttgctcagtcactcatagaccagaaggtaaaagagatatcaaaccaagaacccttaaagatatga

SEQ ID NO: 2770 - RNA, 1302 nt, synthetic construct
  misc_feature 1..1302: note = derived and/or modified CDS sequence (wt) from PUUV(Couvin/59Cg/97)__AJ277034.1__N
  source 1..1302: mol_type = other RNA
atgagtgacttgacagacattcaggaggatataacccgccatgaacaacaacttgttgttgccagacagaaactcaaggatgcagaaaaggcggtggagatggacccagatgacgttaacaaaaacacattgcaagcaaggcaacagacagtgtcagcactggaggacaaacttgcagacttcaagcgacagatggcagatgctgtgtccaggaaaaaaatggatactaaacctactgacccgactgggattgagcctgatgaccatctcaaggagcgatcaagcctcagatatgggaatgtccttgatgtaaatgccattgatatagaagaaccaagtggtcaaacagcagactggtatacaattggagtgtatgttataggcttcacacttcctattatcctgaaggctttatatatgttgtcaacacgtgggagacagactgtgaaagaaaacaaaggaactcgtatccgtttcaaagatgacacttccttcgaggacatcaatggtatcaggagaccaaagcacctatatgtttccatgcctactgctcaatcaactatgaaggctgaagaattaactcctgggcgatttagaaccatagtatgtggtctatttccaactcaaattcaagtacgcaacataatgagccctgtaatgggagtcattggtttttctttttttgtcaaggactgggcagatcggattagggagttcatggaaaaagagtgcccttttatcaaaccagaggtgaagccaggaacaccagcccaggaagctgaattcctaaagaggaacaaaatatactttatgcagaggcaggacgtactggataaaaaccatgttgctgatattgataagttgattgactatgcagcctcaggagatccaacatcaccagataatattgaagccccaaatgcaccctgggtatttgcctgtgcgcctgaccggtgcccaccgacatgtatttatgttgcagggatggctgaattaggtgcattcttttccatattacaggatatgagaaataccatcatggcatctaaaactgttggaacagcagaagaaaagttaaaaaagaaatcatcattttatcaatcatacctgcggaggactcaatcaatgggaatacagcttgaccaaagaattatcttattgtatatgcttgaatggggcaaagagatggtggatcatttccaccttggcgatgatatggatcctgaacttaggggccttgcacaggcacttattgatcaaaaagtgaaggaaatctccaaccaggagcccttaaagatatga

SEQ ID NO: 2771 - RNA, 1302 nt, synthetic construct
  misc_feature 1..1302: note = derived and/or modified CDS sequence (wt) from PUUV(Evo/12Cg/93)__Z30702.1__N
  source 1..1302: mol_type = other RNA
atgagtgacttgacagatatccaagaggatataacccgccatgaacagcagcttgttgttgccagacaaaaacttaaggatgcagagagagcagtggaagtggacccagatgacgttaataaaaacacactacaagccaggcaacaaacagtgtcagcactggaggataaactcgcagactacaagagaaggatggcagatgctgtgtcccggaaaaaaatggatacaaaacctactgatccgactgggattgaacctgatgatcaccttaaggagagatcaagccttaggtatggaaatgtccttgatgtgaatgcaattgatattgaggaaccaagtggtcaaacagcagattggtatacaattggagtttatgtaataggattcacaatccctatcattcttaaagctttgtacatgctttcaacgcgtgggagacagactgtgaaagaaaataaggggacacgtataaggtttaaggatgatacatcatttgaagacatcaatggcataagaagaccaaagcatttatatgtttccatgcccactgctcaatcaactatgaaggcagaagaactcacaccaggtagattccgtacaatagtatgtggtctttttccaactcagatccaagttcgtaacatcatgagtccagttatgggggttattgggttctcattttttgtaaaggattggcctgaaaggatccgagagttcatggaaaaagaatgcccattcataaagccagaaattaagccaggtacaccagcacaggagatggagatgttgaaaaggaataagatctacttcatgcagcgccaggatgtgcttgacaaaaaccatgtggcagacatcgataagctaattgactatgcagcctctggagaccccacatcacctgataacattgattctcctaatgcgccatgggtttttgcatgtgcaccagaccgatgtccaccaacatgtatctatgttgcagggatggcagagcttggggcctttttttcaatattacaggatatgagaaatacaataatggcatctaagactgttggcacagctgaagagaagttgaggaagaagtcctctttctaccaatcttacttacgccggactcaatcaatgggaattcagcttgaccaaagaatcattcttttgttcatgttggaatggggcaaggaaatggtggatcatttccatctaggtgatgatatggatccagaactcagaggtcttgcacaggcactgattgatcaaaaggtgaaggaaatatcaaaccaagagccattaaaaatataa

SEQ ID NO: 2772 - RNA, 1302 nt, synthetic construct
  misc_feature 1..1302: note = derived and/or modified CDS sequence (wt) from PUUV(Evo/14Cg/93)__Z30704.1__N
  source 1..1302: mol_type = other RNA
atgagtgacttgacagatatccaagaggatataacccgccatgaacagcagcttgttgttgccagacaaaaacttaaggatgcagagagagcagtggaagtggacccagatgacgttaataaaaacacactacaagccaggcaacaaacagtgtcagcactggaggataaactcgcaaactacaagagaaggatggcagatgctgtgtcccggaaaaaaatggatacgaaacctactgacccgactgggattgaacctgatgatcacctcaaggagagatcaagccttaggtatggaaatgtccttgatgtgaatgcaattgatattgaggaaccaagtggtcaaacagcagattggtatacaattggagtttatgtaataggattcacaatccctatcattcttaaagccttgtacatgctttcaacgcgtgggagacagactgtgaaagaaaataagggtacacgtataaggtttaaggatgatacatcatttgaagacatcaatggcataagaagaccaaagcatttatatgtttccatgcccactgctcaatcaactatgaaggcagaagaactcacaccaggtagattccgtacaatagtatgtggtctttttccaactcagatccaagttcgtaacatcatgagtccagttatgggggttattggtttctcattttttgtaaaagattggcctgaaaggatccgagagttcatggaaaaagaatgcccattcataaagccagaaattaagccaggtacaccagcacaggagatggagatgttgaaaaggaataagatctacttcatgcagcgccaggatgtgcttgacaaaaaccatgtggcagacatcgataagctaattgactatgcagcctctggaggccccacatcacctgataacattgattctcctaatgcgccatgggtttttgcatgtgcgccagaccgatgtccaccaacatgtatctatgttgcagggatggcagagcttggggcctttttttcaatattacaggatatgagaaatacaataatggcatctaagactgttggcacagctgaagagaagttgaagaagaagtcctctttctaccaatcttacttacgccggactcaatcaatgggaattcagcttgaccaaagaatcattctcttgttcatgttggaatggggcaaggaaatggtggatcatttccatctaggtgatgatatggatccagaactcagaggtcttgcacaggcactgattgatcaaaaggtgaaggaaatatcaaaccaagagccattaaagatataa

SEQ ID NO: 2773 - RNA, 1302 nt, synthetic construct
  misc_feature 1..1302: note = derived and/or modified CDS sequence (wt) from PUUV(Evo/15Cg/93)__Z30705.1__N
  source 1..1302: mol_type = other RNA
atgagtgacttgacagatatccaagaggatataacccgccatgaacagcagcttgttgttgccagacaaggacttaaggatgcagagagagcagtggaagtggacccagatgacgttaataaaaacgcactacaagccaggcaacaaacagtgtcagcactggaggataaactcgcagactacaagagaaggatggcagatgctgtgtcccggaaaaaaatggatacaaaacctactgacccgactgggattgaacctgatgatcacctcaaggagagatcaagccttaggtatggaaatgtcttcgatgtgaatgcaattgatattgaggaaccaagtggtcaaacagcagattggtatacaattggagtttatgtaataggattcacaatccctatcattcttaaagctttgtacatgctttcaacgcgtgggagacagactgtgaaagaaaataagggtacacgtataaggtttaaggatgatacatcatttgaagacatcaatggcataagaagaccaaagcatttatatgtttccatgcccactgctcaatcaactatgaaggcagaagaactcacaccaggtagattccgtacaatagtatgtggtctttttccaactcagatccaagttcgtaacatcatgagtccagttatgggggttattgggttctcattttttgtaaaagattggcctgaaaggatccgagagttcatggaaaaagaatgcccattcataaagccagaaattaagccaggtacaccagcacaggagatggagatgttgaaaaggaataagatctacttcatgcagcgccaggatgtgcttgacaaaaaccatgtggcagacatcgataagctaattgactatgcagcctctggagaccccacatcacctgataacattgattctcctaatgcgccatgggtttttgcatgtgcgccagaccgatgtccaccaacatgtatctatgttgcagggatggcagagcttggggcctttttttcaatattacaggatatgagaaatacaataatggcatctaagactgttggcacagctgaagagaagttgaagaagaagtcctccttctaccaatcttacttacgccggactcaatcaatgggaattcagcttgaccaaagaatcattcttttgttcatgttggaatggggcaaggaaatggtagatcatttccatctaggtgatgatatggatccagaactcagaggtcttgcacaggctctgattgatcaaaaggtgaaggaaatatcaaaccaagagccattaaaaatataa

SEQ ID NO: 2774 - RNA, 1302 nt, synthetic construct
  misc_feature 1..1302: note = derived and/or modified CDS sequence (wt) from PUUV(Faboviken/Mg26/05)__GQ339484.1__N
  source 1..1302: mol_type = other RNA
atgagtgacttggcagatatccaggacgagataacccgccatgaacagcaacttgttgctgccagacaaaaactcaaggatgcagagagagcagtggagatggacccagatgacgttaacaagaatacactgcaagcaaggcaacagacagtgtcagcactggaggacaaactcgcagattttaaacgaagaatggcagatgctgtgtcccggaaaaaaatggatactaaacctactgatccgactgggattgaacctgatgaccaccttaaggaaatatcaagcctcagatatggaaatgtccttgatgtgaatgccattgatattgaagagccgagtggccaaactgcagattggtatactattggagtctatgtaataggctttacactccctattatcttaaaggcactttacatgttgtcaacacgtgggaggcagactgtgaaagaaaataagggaacaaggatcagatttaaggatgacacctcatttgaagatatcaatggcattaggagacctaaacacttatatgtgtctatgcctacagcacaatccacaatgaaagcagaagagttgacaccaggccgatttcgaacaatagtatgtggtttatttcctactcagattcaagtgcgtaatataatgagtccagttatgggggttattggcttttctttctttgttaaagattgggcagaaaggattagagaatttatggaaaaagagtgcccttttataaaaccagaagtaaagcctggaacaccagcacaagaggttgaattcttaaagaaaaacaagatctactttatgcagcgccaggatgtgcttgataaaaatcatgtggctgacatcgataaattgattgattatgctgcctcaggggaccctacatcaccagacaatatagagtctccaaatgcgccatgggtgtttgcctgtgctccagatcgatgtccacctacatgcatttatgttgcaggcatggcagagcttggtgcctttttttcaatcttgcaggatatgagaaatacaataatggcatctaagactgtaggaactgcagaagaaaagttaaagaaaaaatcatctttttaccaatcatatctgcgacggactcaatcaatggggatccaacttgaccagaggattatccttttgtatatgctagaatggggcaaagagatggtggaccatttccatctaggagatgatatggacccagaactgagaggcttggcccaagcactgattgaccagaaggtaaaagaaatatccaaccaggagcctttaaagatttaa

SEQ ID NO: 2775 - RNA, 1302 nt, synthetic construct
  misc_feature 1..1302: note = derived and/or modified CDS sequence (wt) from PUUV(Fyn)__AJ238791.1__N
  source 1..1302: mol_type = other RNA
atgagtgacttaacagacatccaggaggatataacccgccatgaacaacaactggttgttgccagacaaaaacttaaggatgcagaaaaagcagtggaaatggacccagatgacgttaataaaaacacactgcaagcaaggcaacagacagtgtcagcactggaggataaacttgcggacttcaagagaagaatggcagatgctgtgtcccggaaaaagatggatactaaacctactgacccaactgggattgaacctgatgaccacctcaaagaaagatcaagtctcagatacggaaatgtccttgatgtaaatgccatagacattgaagagccaagtgggcagacagcagattggtatactataggagtatatgtgattggttttacacttcccattatattaaaggctctgtatatgttatcaacaaggggaagacagactgtgaaagagaataaaggaacacgtatacgatttaaagatgacacatcctttgaagacataaatggtatcagacgaccgaaacacctatatgtgtcaatgccgactgcccaatcgactatgaaggcagaggagttgacccctggtcgattccgcaccatagtatgcggtttattcccaacacaaattcaagtccgcaatataatgagtcctgtcatgggggtgattggcttctccttctttgttaaggattgggctgagaggataagggagtttatggaaaaggaatgcccctttataaagccagagcttaaaccagggacaaatgcacaagaagctgagttcttaaaaaagaatagggtttactttctgaatcgccaggatgtacttgataagaatcatgttgctgacattgataagctaatagactatgcagcatcaggtgaccctacatcccctgataatattgaagcacctaatgcaccatgggtattttcatgtgccccggatcgatgcccaccaacatgcatttatgttgcagggatggcagaacttggtgcctttttctccatcttacaagatatgaggaatactatcatggcatctaaaactgtaggcacagcagaagaaaagctaaagaaaaaatcatctttctatcaatcatatctgaggcgaactcaatccatggggattcagctggaccaaagaattattcttttgtatatgctcgaatgggggaaagagatggtagatcacttccacctaggtgatgacatggaccctgagcttcgaggtcttgcacaggcactaattgatcagaaagtcaaggaaatatctaatcaagaacctttgaaaatatga

SEQ ID NO: 2776 - RNA, 1302 nt, synthetic construct
  misc_feature 1..1302: note = derived and/or modified CDS sequence (wt) from PUUV(Fyn131)__AJ278093.1__N
  source 1..1302: mol_type = other RNA
atgagtgacttgacagacatccaagaggatataacccgccatgaacaacaactggttgttgccagacaaaaacttaaggatgcagagaaagcagtggaaatggacccagatgacgttaataaaaacacactggaagcaaggcaacagacagtgtcagcactggaggataaactcgcagatttcaagagaagaatgacagatgctgtgtcccggaaaaagatggatactaaacctactgacccaactgggattgaacctgatgaccacctcaaagaaagatcaagtctcagatatggaaatgtccttgatgtaaatgctatagacattgaagagccaagtgggcagacagcagattggtataccataggagtatatgtgattggttttacactccccattatattaaaggctctgtacatgttatcaacaaggggaagacagacggtgaaggagaataaagggacacgtatacggttcaaagatgatacatcttttgaagacataaatggtatcagacgaccgaaacatctatatgtgtcaatgccaactgccccatcaactatgaaggcggaggaattaacccctggtcgattccgcactatagtatgcggtttattcccaacacaaattcaagtccgcaatataatgagtcctgtgatgggggttataggctcttcctttttcgttaaggattgggctgataggataagagaatttatggaaaaggaatgccccttcgtaaagccagagcttaaacctgggacaaatgcacaagaagctgagttcttaaaaaagaatagggtttactttatgaatcgccaggatgtgcttgataagaatcatgtagctgacattgataaactgatagactatgcagcatcaggtgatcctacatgccctgataatattgaagcacctaatgcaccatggggatttgcatgtgccccacataggtgcccaccaacatgcatttatgttgcagggatggcagagcttggtgcctttttctccatcttacaagatatgaggaatactatcatggcatctaaaactgtaggcacagcagaagaaaagctgaagaaaaaatcgtccttctatcaatcatatctgagacgaacccaatccatggggattcagctagaccaaagaattattcttctgtatatgcttgaatggggaagagagatggttgaccacttccatctaggtgatgatatggaccctgaactccgaggccttgcacaggcattaattaatcagaaagtcaaagaaatatctaatcaggaacctttgaagatatga

SEQ ID NO: 2777 - RNA, 1302 nt, synthetic construct
  misc_feature 1..1302: note = derived and/or modified CDS sequence (wt) from PUUV(Fyn47)__AJ278092.1__N
  source 1..1302: mol_type = other RNA
atgagtgacttgacagacatccaagaggatataacccgccatgaacaacaactggttgttgccagacaaaaacttaaggatgcagagaaagcagtggaaatggacccagatgacgttaataaaaacacactgcaagcaaggcaacagacagtgtcagcactggaggataaactcgcagatttcaagagaagaatggcagatgctgtgtcccggaaaaagatggatactaaacctactgacccaactgggattgaacctgatgaccacctcaaagaaagatcaagtctcagatatggaaatgtccttgatgtaaatgctatagacattgaagagccaagtgggcagacagcagattggtataccataggagtatatgtgattggttttacactccccattatattaaaggctctgtacatgttatctaccaggggaagacagacggtgaaggagaataaagggacacgtatacggttcaaagatgatacatcttttgaagacataaatggtatcagacgaccgaaacatctatatgtgtctatgcccactgccccatcaactatgaaggcagaggaattaacccccggtcgattccgcactatagtatgcggtttattcccaacacaaattcaagtccgcaaaataatgagtcctgtaatgggggttataggcttttcctttttcgttaaggattgggttgagaggataagagaatttatggaaaaggaatgccccttcgtaaagccagagcttaaacctgggacaaatgcacaagaagctgagttcttaaaaaagaatagggtttactttatgaatcgccaggatgtgcttgataagaatcatgtagctgacattgataaactgatagactatgcagcatcaggtgatcctacatcccctgataatattgaagcacctaatgcaccatgggtatttgcatgtgccccacataggtgcccaccaacatgcatttatgttgcagggatggcagagcttggtgcctttttctccatcttacaagatatgaggaatgctatcatggcatctaaaactgtaggcacagcagaagaaaagctgaagaaaaaatcgtccttctatcaatcatatctgagacgaacccaatccgtggggattcagctagaccaaagaattattcttctgtatatgcttgaatggggaagagagatggttgaccacttccatctaggtgatgatatggaccctgaactccgaggccttgcacaggcattaattgatcagaaagtcaaagaaatatctaatcaggaacctttgaagatatga

SEQ ID NO: 2778 - RNA, 1302 nt, synthetic construct
  misc_feature 1..1302: note = derived and/or modified CDS sequence (wt) from PUUV(Gomselga)__AJ238790.1__N
  source 1..1302: mol_type = other RNA
atgagtgacttgacagatatccaagaggatataacccgccatgaacagcagcttgttgttgccagacaaaaacttaaggatgcagaaagagcagtggaagtggacccagatgacgttaataaaaacacactgcaagccaggcaacagacagtgtcagcactggaggacaaactcgcagactacaagagaaagatggcagatgctgtgtcccggaaaaaaatggatactaaacctactgacccgactgggattgaacctgatgatcacctcaaagagagatcaagcctcaggtatggaaatgtcctcgatgtgaatgcaattgatattgaggacccaagtggccaaacagcagattggtatacaatcggagtttatgtaatagggttcacacttcctatcatccttaaagctttatacatgctctcaacgcgtgggagacagactgtaaaggaaaataaggggacacgtataaggtttaaggatgatacatcatttgaggagatcaatggcataaggagaccaaagcatctatatgtctccatgcctactgctcagtcaaccatgaaggcagaggaactcacaccaggcagatttcgtacaatagtatgtggtctatttcccactcagatccaagttcgtaatatcgtcagtcctgttatgggggtcattggtttttcattctttgtgaaagactggtcacagagaatcacagagttcatggaaaaggagtgcccattcataaaaccagaagttaagccaggtacaccggcacaagagattgagatgtttaaaagaaataagatctatttcatgcagcgccaggatgtgcttgacaaaaatcatgtggcagacattgataagtcaattgactatgcagcctctgaagaccctacatcacctgacaacattgactctcctaatgcaccatgggtctttgcctgtgcaccagatcggtgtccaccaacatgtatctatgttgcagggatggcagagctcggggcttttttttcaatattgcaggatatgaggaatactattatggcctccaagactgttggcaccgctgaagagaaattaaagaagaaatcctctttttaccaatcttacctacgtcgaactcaatcaatgggaattcagcttgaccaaagaatcattctcttgttcatgttggagtggggtaaagagatggtggatcacttccatcttggtgatgatatggatccagagctcagaggtcttgcacaggcactgatagatcaaaaggtgaaggaaatatcaaaccaagagccattaaaaatataa

SEQ ID NO: 2779 - RNA, 1302 nt, synthetic construct
  misc_feature 1..1302: note = derived and/or modified CDS sequence (wt) from PUUV(Gyttjea/Mg19/05)__GQ339480.1__N
  source 1..1302: mol_type = other RNA
atgagtgacttgacagatatccaagaggatataacccgccatgaacaacagcttgttgttgccagacaaaaacttaaagatgcagaaaaggcagtggagatggacccggatgacgttaacaaaaacacactgcaagcaaggcaacagacagtgtcagcactggaggataaactcgcagacttcaagcgacagatggcagatgctgtgtccaggaagaagatggatactaagcctactgatccaactgggattgagccagatgaccacctcaaggaaagatcaagtttgcgatatggaaatgtccttgatgtgaatgctattgacatagaagagccaagtggtcagacagcagattggtatactattggagtgtatgtaatagggtttacactgcctattatcttgaaggccctttacatgctttcaacacgtgggaggcaaactgttaaggagaacaaagggacacgtattcgcttcaaagatgacacttcatttgaggacattaatggtatcagacgaccgaaacacctttatgtatccatgcccactgctcaatccaccatgaaagcagaagaactcacaccagggcggttccgtacaatagtttgcgggttgtttcctacccagatccaagtgcgaaatataatgagtccagtaatgggagtgattggatttgctttttttgttaaaggttgggcagacaggatcagagagtttatggaaaaggagtgcccattcataaaaccagaggttaaaccaggaacaccgacacaggaaattgaatttctgaagaagaataaagtctatttcttggaccgtcaaactgttcttgacaaaaatcatgtggccgacattgataagttaattgactatgctgcctcaggggatccaacatcacccgacaacatcgaatctcctaatgcaccatgggtttttgcatgtgcccctgatcggtgcccaccgacctgtatctatgttgcaggaatggcagagcttggtgcatttttctcgattctgcaggatatgagaaacaccataatggcctcaaagactgttggcacagctgaagagaagcttaagaaaaaatcttcattttatcaatcctacctacgacggacacagtcaatgggaatccagctcgaccaaaggattattctcctgtttatgttagagtggggaaaagaaatggttgaccactttcacttgggtgacgatatggatcctgagcttagaggtcttgcccaggcactgattgatcagaaggtgaaggagatctctaatcaggaaccacttaaaatatag

SEQ ID NO: 2780 - RNA, 1302 nt, synthetic construct
  misc_feature 1..1302: note = derived and/or modified CDS sequence (wt) from PUUV(Karhumaki)__AJ238788.1__N
  source 1..1302: mol_type = other RNA
atgagtgacttgacagatatccaagaggatataacccgccatgaacagcagcttgttgttgccagacaaaaacttaaggatgcagaaagagcagtggaagtggacccagatgacgttaataaaaacacactgcaagccaggcaacagacagtgtcagcactggaggacaaactcgcagactacaagagaaagatggcagatgctgtgtcccggaaaaaaatggatactaaacctactgacccgactgggatgaaacctgatgttcacctcaaagagagatcaagcctcgagtatggaaatgtcctcgatgtgaatgcaattgatattgaggaaccaagtggccaaacagcagattggtatacaatcggagtttatgtaataggattcacacttcctattatccttaaagccctatacatgctttcaacacgagggagacagactgtaaaggaaaataaggggacgcgcataaggttcaaggatgatacatcatttgaagacatcaatggcataaggagaccaaagcatctatatgtttctatgcctactgctcaatcaactatgaaggcagaagaactcacaccaggtagatttcgtacaatagtatgtggtctatttccaactcagatccaagttcgtaacatcatgagtccagttatgggggttattggtttctcattttttgtcaaagattggtcagagagaatccgagagttcatggagaaggagtgcccatttataaaaccagaagttaagccaggtacaccagcacaggagattgagatgttaagaagaaataagatctatttcatgcagcgccaagatgtacttgacaaaaatcatgtggcagacattgataagttaattgatctcgcagcttctggagaccctacatcacctgataacattgactcacccaatgcaccatgggtctttgcatgtgcaccagttcgatgtccaccaacatgtatctatgttgcagggatggcagaacttggggcctttttttcaatattgcaggatatgaggaatacaataatggcatctaagactgtgggcactgctgaagagaaattaaagaaaaaatcctctttttaccagtcttatttacgccgaactcaatcgatgggaattcagcttgaccaaaggatcattctcttgttcatgttggaatggggcaaagagatggtagatcattttcatcttggtgatgatatggatccagagctcagaggtcttgcacaagcactgatagaccaaaaggtgaaagaaatatcaaaccaggagccattaaagatataa

SEQ ID NO: 2781 - RNA, 1302 nt, synthetic construct
  misc_feature 1..1302: note = derived and/or modified CDS sequence (wt) from PUUV(Kolodozero)__AJ238789.1__N
  source 1..1302: mol_type = other RNA
atgagtgacttgacagatatccaagaggatataacccgccatgaacagcaacttgttgttgccagacaaaaacttaaagatgcagagagagcagtggaagtggacccagatgacgttaataaaaacacactgcaagccaggcaacagacagtgtcagcactggaggacaaactcgcggactacaagagaaggatggcagatgctgtgtcccggaaaaaaatggatactaaacctactgatccgactgggattgaacctgatgaccacctcaaggagagatcaagcctcaggtatggaaatgtccttgatgtgaatgcaattgatattgaggaaccgagtggccaaacagcagattggtatacaattggagtctatgtaataggatttacacttcccattattcttaaggctttatacatgctttcaacgcgtgggagacagactgtgaaggaaaacaaggggacacgcataaggttcaaggatgatacatcatttgaagacatcaatggcataaggagaccaaagcatttatatgtttctatgcccactgctcagtcaaccatgaaggcagaagaactcacaccaggcagatttcgtacaatagtatgtggtctaattccgactcagattcaagttcgtaacatcatgagtccagttatgggggttattgggttttcattcttcgtaaaggattggtcagagaggatcagagagttcatggaaaaggagtgcccatttataaagccagaagttaagccaggtacatcagcacaagagattgagatgttgaaaaggaataagatctatttcatgcagcgccaagatgtgcttgacaaaaaccatgtggccgacattgacaagctaattgactatgcagcctctggagaccctacgtcacctgataacattgactcacccaatgcaccatgggtctttgcatgtgcaccagatcgatgtccgccaacatgtatctatgttgcaggaatggcagagcttggggcctttttttcaatattgcaggacatgagaaatacaataatggcatctaaaactgtcggcacagctgaagagaagttgaagaaaaaatcatccttttaccaatcttacctacgccggactcaatccatgggaattccacttgaccaaaggatcattcttttattcatgttggaatggggccaagagatggtagatcacttccatcttggtgatgatatggacccagaactcaggggtcttgcacaggcactgatagatcagaaggtaaaggaaatatcaaaccaggagccattgaaaatataa

SEQ ID NO: 2782 - RNA, 1302 nt, synthetic construct
  misc_feature 1..1302: note = derived and/or modified CDS sequence (wt) from PUUV(Kuhmo/X11)__GU808825.1__N
  source 1..1302: mol_type = other RNA
atgagtgacttgacagatatccaagaggatataacccgccatgaacagcagcttgttgttgccagacaaaaacttaaggatgcagagagagcagtgggagtggacccagatgacgttaataaaaacacactgcaagccaggcaacagacagtgtcagcactggaagacaaactcgcagactacaagagaagaatggcagatgctgtgtcccggaaaaagatggatactaagcctactgacccgactgggattgaacctgatgatcacctcaaggagagatcaagccttaggtatggaaatgtccttgatgtgaatgcaattgatattgaggaaccaagtggccaaacagcagattggtatacaattggagtttatgtgataggatttacactccctatcatccttaaagccttatacatgctgtcaacgcgtgggagacaaactgtgaaggaaaataaggggacacgcataaggttcaaggatgatacgtcatttgaagacatcaatggcataaggagaccaaagcatttatatgtttccatgcccacagctcagtcaaccatgaaggcagaggaactcacaccgggcagattccgcacaatagtatgtggtctgttcccaactcagatccaagttcgtaacatcatgagtccagttatgggggttattggtttttcattttttgtaaaagattggtcagagagaatcagagagttcatggaaaaagagtgcccattcataaagccagaagttaagccaggtacaccagcacaagagattgagatgttaaaaagaaataggatctacttcatgcagcgccaagatgtgcttgacaagaatcatgtagcagatattgataagttgattgactatgcagcctctggagaccctacatcacctgataacattgattctcctaatgcaccgtgggtttttgcgtgtgcaccagaccgatgcccaccgacatgtatctatgttgcaggtatggcagaacttggggcctttttttcaatactgcaagacatgaggaatacaataatggcatctaaaactgttggcacatctgaagagaagttaaagaaaaagtcctctttctaccaatcttacttgcgccgaactcaatcaatgggaattcaacttgaccaaaggattattctcttattcatgttggaatggggcaaagagatggtagatcacttccaccttggtgatgatatggatccagagctcagaggtcttgcacaggcactgattgatcaaaaggtgaaggaaatatcaaaccaggagccactaaaaatataa

SEQ ID NO: 2783 - RNA, 1302 nt, synthetic construct
  misc_feature 1..1302: note = derived and/or modified CDS sequence (wt) from PUUV(Kuhmo/X5)__GU808824.1__N
  source 1..1302: mol_type = other RNA
atgagtgacttgacagatatccaagaggatataacccgccatgaacagcagcttgttgttgccagacaaaaacttaaggatgcagagagagcagtggaagtggacccagatgacgttaataaaaacacactgcaagccaggcaacagacagtgtcagcattggaagacaaactcgcagactacaagagaagaatggcagatgctgtgtcccggaaaaagatggatactaagcctactgacccgactgggattgaacctgatgatcacctcaaggagagatcaagccttaggtatggaaatgtccttgatgtgaatgcaattgatattgaggaaccaagtggccaaacagcagattggtatacaattggagtttatgtaataggatttacactccctatcatccttaaagccttgtacatgctgtcaacgcgtgggagacaaactgtgaaggaaaataagggaacacgcataaggttcaaggatgatacgtcatttgaagacatcaatggcataaggagaccaaagcatttatatgtttccatgcccacagctcagtcaaccatgaaggcagaggaactcacaccaggcagattccgcacaatagtatgtggtctgtttccaactcagatccaagttcgtaacatcatgagtccagttatgggggttattggtttttcattttttgtaaaagattggtcagagagaatcagagagttcatggaaaaagagtgcccattcataaagccagaagttaagccaggtacaccagcacaagagattgagatgttaaaaagaaataggatctacttcatgcagcgccaagatgtgcttgacaagaatcatgtagcagacattgataagttaattgactatgcagcctctggagaccctacatcacctgataatattgattctcctaatgcaccgtgggtttttgcgtgtgcaccagaccgatgcccaccgacatgtatctatgttgcagggatggcagaacttggggcctttttttcaatactgcaagacatgagaaatacaataatggcatctaaaactgttggcacagctgaagagaagttaaagaaaaagtcctctttttaccaatcttacttgcgccgaactcaatcaatgggaattcaactcgaccaaaggattattctcttattcatgttggaatggggcaaagagatggtagatcacttccaccttggtgatgatatggatccagagctcagaggtcttgcacaggcactgattgatcaaaaggtgaaggaaatatcaaaccaggagccactaaaaatataa

SEQ ID NO: 2784 - RNA, 1302 nt, synthetic construct
  misc_feature 1..1302: note = derived and/or modified CDS sequence (wt) from PUUV(Ljustrask/Mg20/05)__GQ339481.1__N
  source 1..1302: mol_type = other RNA
atgagtgacttgacagatatccaagaggatataacccgccatgaacaacagcttgttgttgctagacaaaaacttaaagatgcagaaaaggcagtggagatggacccggatgacgttaacaaaaacacactgcaagcaaggcaacagacagtgtcagcactggaggacaaactcgcagacttcaagcgacagatggcagatgctgtgtccaggaagaagatggatactaagcctactgatccaactgggattgagccagatgaccacctcaaggagagatcaagcttgcgatatggaaatgtccttgatgtgaatgctatcgacatagaagagccaagtggtcagacagcagactggtatactattggagtgtatgtaatagggtttacactgcctattattttgaaggccctttacatgctttcaacacgtgggaggcaaactgttaaggagaacaaagggacacgtattcgcttcaaagacgacacctcattcgaggacattaatggtatcagacgaccgaaacatctttatgtatccatgcccactgcccaatccaccatgaaagcagaagaactcacaccaggacggttccgtacaatagtttgcgggttgtttcctacacagatccaagtacgaaacataatgagtccagtaatgggagtgattggatttgctttctttgttaaaggttgggcagacaggatcagagagttcatggaaaaggagtgcccattcataaaaccagaggttaagccaggaacaccgacacaggaaattgaattcttgaagaagaataaagtctatttcttggaccgtcaaaatgttctagacaaaaatcatgtggccgatattgataagttaattgactatgctgcctcaggggatccaacatcacctgacaacatcgaatcccctaatgcaccatgggtttttgcatgtgcccctgatcggtgcccaccaacctgtatctatgttgcaggaatggcagaacttggtgcatttttctcaattttgcaggatatgagaaacaccataatggcctcaaagactgttggcacagctgaagagaagcttaagaaaaaatcttcattttatcaatcctacctacgacggacacagtcaatgggaatccagctcgaccaaaggattattcttctgtttatgttagaatggggtaaagaaatggttgaccactttcacttgggtgatgatatggatcctgagcttagaggtcttgcccaggcattgattgatcagaaggtgaaggagatctctaatcaggaaccacttaaaatatag

SEQ ID NO: 2785 - RNA, 1302 nt, synthetic construct
  misc_feature 1..1302: note = derived and/or modified CDS sequence (wt) from PUUV(Mangelbo/Mg1/05)__GQ339485.1__N
  source 1..1302: mol_type = other RNA
atgagtgacttgacagatatccaggacgaaataacccgccatgaacagcaactggttgctgccagacaaaaactcaaggatgcagagagggcagtggaaatggacccagatgacgttaacaagaacacactgcaagcaagacaacagacagtgtcagcattggaggataaactcgcagatttcaaacgaagaatggcagatgctgtgtcccggaagaaaatggatactaaacctactgatccgactgggattgaaccagatgatcatctcaaagaaagatcaagtctcagatatggggatgtccttgatgtgaatgctattgatattgaagagccaagtggtcaaactgcagattggtatactattggagtttatgtgataggctttacactccctattattttaaaggcactctacatgttgtcaacacgtggaagacaaactgtaaaagaaaacaaagggacaaggattagatttaaggatgacacctcatttgaagacatcaatggcatcaggagaccaaagcacttatatgtgtctatgcccacagcacagtcaacaatgaaagcagaagagttaacaccaggtcgatttcggacaatagtatgtggcctatttcccacccagattcaagtgcgtaatataatgagtccagttatgggggtcattggcttttctttctttgtcaaggattgggcagaaaggattagggaatttatggataaggaatgccctttcataaaaccagaagtaaaacctggaacaccagcgcaggaaattgaattcttgaagaaaaacaagatctactttatgcaacgtcaggatgtacttgacaaaaatcatgtggctgacattgataaattgattgattatgctgcctcaggagacccaacatcacctgacaatattgagtctccaaatgcaccatgggtgtttgcctgtgctccagatcgatgtccacctacatgcatttatgttgcaggtatggcagagttaggtgccttcttctcaatcctacaagatatgagaaatacaatcatggcatctaaaactgtgggtacagcagaggagaagttaaagaaaaaatcatccttttaccagtcttatctgcgacggactcagtcaatgggaatccaacttgaccaaagaattatcctattgtatatgcttgaatggggcaaagagatggtagaccatttccatctaggagatgacatggatccagaactgagaggtttgacccaagcactaatcgaccaaaaggtaaaggaaatatctaacccagagcctttaaagatttga

SEQ ID NO: 2786 - RNA, 1302 nt, synthetic construct
  misc_feature 1..1302: note = derived and/or modified CDS sequence (wt) from PUUV(Momignies/55Cg/96)__AJ277033.1__N
  source 1..1302: mol_type = other RNA
atgagtgacttgacagacattcaggaggatataacccgccatgaacaacaacttgttgttgccagacagaaactcaaggatgcagaaaaggcggtggagatggacccagatgacgttaacaaaaacacattgcaagcaaggcaacagacagtgtcagcactggaggacaaacttgcagacttcaagcgacagatggcagatgctgtgtccaggaaaaaaatggatactaaacctactgacccgactgggattgagcctgatgaccatctcaaggagcgatcaagcctcagatatgggaatgtccttgatgtaaatgccattgatatagaagaaccaagtggtcaaacagcagactggtatacaattggagtgtacgtcataggcttcacacttcctattatcctgaaggctttatatatgttgtcaacacgtgggagacagactgtgaaagaaaacaaagggactcgtatccgtttcaaagatgacacttccttcgaggacatcaatggtatcaggagatcaaaacacctatatgtttccatgcctactgctcaatcaactatgaaggctgaagaattaacccctgggcgatttagaaccatagtatgtggtctatttccaactcaaattcaagtacgcaacataatgagtcctgtgatgggagtcattggtttttctttttttgtcaaggactgggcagatcggattagggaattcatggaaaaagagtgcccctttatcaaaccagaggtgaagccaggaacaccagcccaggaagctgaattcctaaagaggaacaaaatatactttatgcagagacaggacgtactggataaaaatcatgttgctgatattgataagttgattgactacgcagcctcaggagatccaacatcaccagacaatattgaagccccaaatgcaccctgggtatttgcctgtgcgcctgaccggtgcccaccgacatgtatttatgttgcagggatggctgaattaggtgcattcttttccatattacaggatatgaggaatactatcatggcatctaaaactgttggaacagcagaagaaaagttaaagaagaaatcatcattttatcaatcatacctgcggaggactcaatcaatgggaatacagcttgaccaaagaattatcttattgtatatgcttgaatggggcaaagagatggtggatcatttccaccttagcgatgatatggatcctgaacttaggggccttgcacaggcacttattgatcaaaaagtgaaggaaatctccaaccaggagcccttaaagatatga

SEQ ID NO: 2787 - RNA, 1302 nt, synthetic construct
  misc_feature 1..1302: note = derived and/or modified CDS sequence (wt) from PUUV(Montbliart/23Cg/96)__AJ277031.1__N
  source 1..1302: mol_type = other RNA
atgagtgacttgacagacattcaggaggatataacccgtcatgaacaacaacttgttgttgccagacagaaactcaaggatgcagaaaaggcggtggagatggacccagatgacgttaacaaaaacacattgcaagcaaggcaacagacagtgtcagcactggaggacaaacttgcagacttcaagcgacaaatggcagatgctgtgtccaggaaaaaaatggatactaaacctactgacccgactgggattgagcctgatgaccatctcaaggagcgatcaagcctcagatatggaaatgtccttgatgtaaatgccattgatatagaagaaccaagtggtcaaacagcggactggtatacaattggggtgtatgttataggcttcacacttcctattatcctgaaggctctatatatgttgtcaacacgtgggagacaaactgtgaaagaaaacaaagggactcgtatccgttttaaagatgatacttcctttgaggacattaatggtatcaggagaccgaagcacctatatgtttccatgcctactgctcaatcaactatgaaggctgaagaactgacccctggacgatttagaaccatagtatgcggtctatttccgactcaaattcaagtacgcaacataatgagccctgtaatgggagtcattggtttttccttttttgtcaaggactgggcagatcggattagggaattcatggaaaaagagtgcccttttatcaaaccagaggtgaagccaggaacaccagcccaggaagctgaattcttaaggaggaacaaaatatactttatgcagaggcaggaagtactggataaaaaccatgttgctgatattgacaagttgattgactatgcagcctcaggagatccaacatcaccagataatattgaagccccaaatgcaccctgggtgtttgcctgtgcacctgaccggtgcccaccgacatgtatttatattgcagggatggctgaattaggtgcattcttttccatattacaggatatgagaaatactatcatggcatctaaaactgttggaacagcagaagaaaagttaaaaaagaaatcatcattttatcaatcatacctgcggaggactcaatcaatgggaatacagcttgaccaaagaattatcttactgtatatgcttgaatggggcaaagaaatggtagatcatttccaccttggcgatgatatggatcctgaacttaggggccttgcacaggcacttattgatcaaaaagtgaaggaaatctccaaccaggagcccttaaagatatga

SEQ ID NO: 2788 - RNA, 1302 nt, synthetic construct
  misc_feature 1..1302: note = derived and/or modified CDS sequence (wt) from PUUV(MuEb10Karlstadt/10)__JN696373.1__N
  source 1..1302: mol_type = other RNA
atgagtgatttgacagatattcaagaggatataacccgccatgaacaacaacttgttgttgccagacaaaagctcaaggatgcagaaaaggcggtggaaatggacccagatgacgttaacaaaaacacactgcaagcaaggcaacaaacagtgtcagcactggaagataaactcgcagattacaagcgaagaatggcagatgctgtgtccaggaaaaagatggatactaagcctactgacccgactgggattgagcctgatgaccatcttaaagaacgatcaagtctcaggtatggaaatgtccttgatgtgaatgccattgacatagaggaaccgagtggtcaaacagcggactggtatacgattggggtctatgtcatagggtttacacttcctatcatcttgaaggccttatatatgttgtcaacccgcgggagacaaactgtaaaagagaacaaagggactcgcattcgatttaaagatgatacttcatttgaggatattaatggtatcaggaggccaaagcacttatatgtgtctatgccaactgcccagtcaaccatgaaagctgaagaattaacccctggtaggttcagaactatagtatgtggcctatttccgactcaaatccaagttcgcaacataatgagtcctgtaatgggagtaattggcttttccttttttgtgaaagattgggcagaacgaatcagggagtttatggaaaaagaatgccccttcattaaaccagaaattaaaccaggaacaccagtacaggaggctgagttcttgaagagaaataaggtttactttatgcaacgccaagaggtattggataaaaatcatgttgctgacattgataagttaattgattatgcagcatcaggggatcccacatcacctgataatattgagtctcctaatgctccatgggtgtttgcatgtgcccctgatagatgtccaccaacttgcatttatgttgcaggaatggcagagctaggtgcttttttctccatactacaggatatgagaaataccatcatggcatccaaaactgtaggcacagctgaagagaagttaaaaaagaaatcatcattttatcaatcatatctgcgcaggactcaatcaatggggatacaattggaccaaaggatcattctattgtatatgcttgaatggggcaaagaaatggtggaccactttcacttgggtgatgatatggacccagaactcagaggccttgcacaggcactcattgatcagaaagtaaaggaaatatccaatcaagagcccctaaaaatataa

SEQ ID NO: 2789 - RNA, 1302 nt, synthetic construct
  misc_feature 1..1302: note = derived and/or modified CDS sequence (wt) from PUUV(MuEb12Lackenberg/10)__JN696374.1__N
  source 1..1302: mol_type = other RNA
atgagtgacttgacagacattcaggaggatataacccgccatgaacaacaacttgttgttgccagacaaaagctcaaggatgcagaaaaggcggtggaaatggacccagatgacgttaacaagaacacattacaagcaaggcaacaaacagtgtcagcactggaagacaaactcgcggattacaagagaagaatggcagatgctgtgtcccggaaaaagatggatactaagcctactgatccgactgggattgaaccggatgaccatcttaaagaacgatcaagccttaggtatggaaatgtccttgatgtgaatgctattgacatagaagaaccgagtggtcaaacagcagattggtatacaattggggtttatgtcataggtttcacactccctatcatcttaaaggccttgtatatgttatcaacccgcgggagacagactgtgaaggagaacaaagggactcgcatccggttcaaagatgatacttcatttgaggacattaatggtattaggagaccaaagcatttgtatgtgtccatgcccactgctcagtcaactatgaaagctgaggaattaacccctggtaggttcaggactatagtctgcggtttatttccaactcaaattcaagtacgtaatataatgagtcctgtgatgggagtcatcggtttttctttttttgtaaaggattgggcagaacgtattagagaatttatggagaaagaatgccccttcatcaaaccagaaatgaaaccagggacaccagcacaggaggcggagttcttaaagagaaataaagtttactttatgcaacgccaagatgtattggacaaaaatcatgtggctgatattgataagttaattgattatgcagcctcaggagatcctacatcacctgacaacattgagtctcctaatgccccatgggtatttgcatgtgcccctgacagatgcccaccaacttgtatttatgttgcgggaatggcagagttaggtgcctttttctccatattgcaggatatgagaaacaccattatggcatctaaaactgttggcacagctgaggaaaaactgaaaaagaagtcatcattttatcaatcatatctacgtagaactcagtcaatgggaatacaactagaccaaagaattattctcttatatatgcttgaatggggtaaggaaatggttgatcattttcatctgggtgatgacatggatccagaacttagaggccttgcacaagcacttattgaccaaaaagtaaaggaaatatccaatcaggagcccttaaaaatatga

SEQ ID NO: 2790 - RNA, 1302 nt, synthetic construct
  misc_feature 1..1302: note = derived and/or modified CDS sequence (wt) from PUUV(Munga/Mg16/05)__GQ339487.1__N
  source 1..1302: mol_type = other RNA
atgagtgacttgacagatatccaggacgaaataacccgccatgaacagcaactggttgctgccagacaaaaactcaaggatgcagagagggcagtggaaatggacccagatgacgttaacaagaacacactgcaagcaagacaacagacagtgtcagcactggaggataaactcgcagatttcaaacgaagaatggcagatgctgtgtcccggaaaaaaatggatactaaacctactgatccgactgggattgaaccagatgatcatctcaaggaaagatcaagtctcagatatggaaatgtccttgatgtgaatgctattgatattgaagagccaagtggtcaaactgcagattggtatactattggagtttatgtgataggctttacactccctattattttaaaggcactctacatgttgtcaacacgtggaagacaaactgtaaaggaaaacaaagggacaaggatcagatttaaggatgacacctcatttgaagacatcaatggcatcaggagaccaaagcacttatatgtgtctatgcccacagcacagtcaacaatgaaagcagaagagttaacaccaggtcgattccggacaatagtatgtggcctattccctacccagattcaagtacgtaatataatgagtccagttatgggggtcattggcttttctttctttgtcaaggattgggcagaaaggattagggaatttatggagaaggaatgccctttcataaaaccagaagtaaaacctggaacaccagcgcaggaaattgaattcttaaagaaaaataagatctactttatgcaacgtcaggatgtgcttgacaaaaatcatgtggctgacattgataaattgattgattatgctgcctcaggagacccaacatcacctgacaatattgagtctccaaatgcaccatgggtgtttgcatgtgctccagatcgatgtccacctacatgcatttatgttgcaggtatggcagagttaggtgccttcttctcaatcctacaagatatgagaaatacaatcatggcatctaaaactgtgggtacagcagaggagaagttaaagaaaaaatcatccttttaccagtcttatctgcgacggactcagtcaatgggaatccaacttgaccaaagaattatcctattgtatatgcttgaatggggcaaagagatggtagaccatttccatctaggagatgacatggatccagaactgagaggtttggcccaagcactaatcgaccaaaaggtaaaggagatatctaaccaagagcccttaaagatttga

SEQ ID NO: 2791 - RNA, 1302 nt, synthetic construct
  misc_feature 1..1302: note = derived and/or modified CDS sequence (wt) from PUUV(Munga/Mg2/05)__GQ339486.1__N
  source 1..1302: mol_type = other RNA
atgagtgacttgacagatatccaggacgaaataacccgccatgaacagcaactggttgctgccagacaaaaactcaaggatgcagagagggcagtggaaatggacccagatgacgttaacaagaacacactgcaagcaagacaacagacagtgtcagcactggaggataaactcgcagatttcaaacgaagaatggcagatgctgtgtcccggaaaaaaatggatactaaacctactgatccgactgggattgaaccagatgatcatctcaaggaaagatcaagtctcagatatggaaatgtccttgatatgaatgctattgatattgaagagccaagtggtcaaactgcagattggtatactattggagtttatgtgataggctttacactccctattattttaaaggcactctacatgttgtcaacacgtggaagacaaactgtaaaggaaaacaaagggacaaggatcagatttaaggatgacacctcatttgaagacatcaatggcatcaggagaccaaagcacttatatgtgtctatgcccacagcacagtcaacaatgaaagcagaagagttaacaccaggtcgattccggacaatagtatgtggcctattccctacccagattcaagtacgtaatataatgagtccagttatgggggtcattggcttttctttctttgtcaaggattgggcagaaaggattagggaatttatggagaaggaatgccctttcataaaaccagaagtaaaacctggaacaccagcgcaggaaattgaattcttaaagaaaaataagatctactttatgcaacgtcaggatgtgcttgacaaaaatcatgtggctgacattgataaattgattgattatgctgcctcaggagacccaacatcacctgacaatattgagtctccaaatgcaccatgggtgtttgcctgtgctccagatcgatgtccacctacatgcatttatgttgcaggtatggcagagttaggtgccttcttctcaatcctacaagatatgagaaatacaatcatggcatctaaaactgtgggtacagcagaggagaagttaaagaaaaaatcatccttttaccagtcttatctgcgacggactcagtcaatgggaatccaacttgaccaaagaattatcctattgtatatgcttgaatggggcaaagagatggtagaccatttccatctaggagatgacatggatccagaactgagaggtttggcccaagcactaatcgaccaaaaggtaaaggagatatctaaccaagagcccttaaagatttga

SEQ ID NO: 2792 - RNA, 1302 nt, synthetic construct
  misc_feature 1..1302: note = derived and/or modified CDS sequence (wt) from PUUV(PUU/Cg-Erft)__AJ238779.1__N
  source 1..1302: mol_type = other RNA
atgagtgacttgacagacattcaggaggatataacccgccatgaacaacaacttgttgttgccagacaaaagctcaaggatgcagaaaaggcagtggagatggacccagatgacgttaacaagaacacattgcaagcaaggcaacagacagtgtcagcactggaggacaaacttgcagacttcaagcgacaaatggcagatgctgtgtccaggaaaaagatggatactaaacctactgacccgactgggattgagcctgatgaccatctcaaggagcgatcaagcctcagatatgggaatgtccttgatgtgaatgccattgatatagaagaaccaagtggtcaaacagcagactggtatacaattggagtgtatgttataggcttcacacttcctattatcctgaaggctctgtatatgttgtcgacacgtgggagacaaactgtgaaagagaacaaagggactcgtatccgcttcaaagatgatacatcctttgaagacatcaacggtatcaggagaccaaagcacctatatgtctctatgcctactgctcaatcaactatgaaggctgaagaattgacccctggacgatttagaaccatagtatgcggtctatttccaactcaaattcaagtacgcaacataatgagccctgtgatgggagtcattggattttctttttttgttaaggactgggctgaccggattaaaaaattcatggaaaaagaatgcccttttattaaaccagaggtaaagccagggacaccatctcaggaagctgaatttctaaagatgaatagaatatactttatgcagaggcaagaagtattggataaaaaccatgttgctgatattgacaagctgattgattatgcagcctcaggagatccaacatcaccagataatattgaggccccaaatgcaccctgggtatttgcctgtgcacccgatcgatgcccaccaacatgcatttacgttgcagggatggctgaattaggtgcattcttttctatattgcaggatatgagaaataccatcatggcatctaaaactgttggaacagcagaagaaaagttaaaaaagaagtcatcattttatcaatcatatcttcggaggactcaatcaatgggaatacagcttgaccaaagaattatcttattgtacatgcttgaatggggcaaagaaatggtggatcatttccacctcggcgatgatatggatcctgaacttaggggccttgcacaggcacttattgaccaaaaagtgaaggaaatatccaaccaagagcccttaaaaatatga

SEQ ID NO: 2793 - RNA, 1302 nt, synthetic construct
  misc_feature 1..1302: note = derived and/or modified CDS sequence (wt) from PUUV(Puu/Kazan)__Z84204.1__N
  source 1..1302: mol_type = other RNA
atgagtgacttgacagacatccaagaggagataacccgccatgagcaacaacttgttgttgccagacaaaaactcaaggatgcagagagagcagtggaagtggacccggatgacgttaacaaaaacacactacaagcaaggcaacaaacagtgtcagcattggaggataaactcgcagactacaagagaagaatggcagatgctgtgtcccggaaaaaaatggatactaaacctactgacccgactgggattgaacctgatgatcatctcaaggagagatcaagccttagatatggaaatgtccttgatgtaaatgccattgacatcgaagaaccaagtggtcagacagcagattggtatactattggagtctatgtaataggttttacaattcccatcattttaaaggctctatacatgttgtcaacacgtggaagacagaccgtaaaagaaaataaaggaacacggatcaggttcaaagatgacacatcgtttgaggatattaatggcatcaggagaccaaaacatctatatgtatccatgcctactgcccagtccaccatgaaagctgaagaacttacacccggacggttccgtacaatagtatgtggcttatttcctacacagatacaagtgcgtaacatcatgagtccagtaatgggagtgattggtttttctttctttgtcaaagactggccagagaggattagggattttatggaaaaggaatcccccttcataaagccagaagttaaacccgggacaccagcacaggagatagaatttttgaaaagaaacagggtttatttcatgactcgccaagatgttcttgataaaaatcatgtggctgacattgataagttaattgactatgctgcctctggtgaccctacatcacctgatgacattgaatcccctaatgcaccgtgggtatttgcctgtgcaccagatcggtgtccccctacatgcatttatgttgctgggatggctgaattgggtgcattcttttcgatcctacaggatatgaggaacactattatggcatctaaaactgtaggtacagcagaagaaaaattaaaaaagaagtcctccttctatcaatcatacctacgccggacacaatcaatggggattcaacttgatcagaggataatcctactgtacatgttggagtgggggaaagaaatggtggatcatttccatcttggtgatgatatggatcctgagctaagaggccttgctcagtcactcatagaccagaaggtaaaagagatatcaaatcaggagcccttaaagatatga

SEQ ID NO: 2794 - RNA, 1302 nt, synthetic construct
  misc_feature 1..1302: note = derived and/or modified CDS sequence (wt) from PUUV(PUU/Mignovillard/CgY02/2005)__AM695638.1__N
  source 1..1302: mol_type = other RNA
atgggtgacttgacagacatacaagaggatataacccgccatgaacaacaacttgttgttgccagacagaaactcaaggatgcagaaaaggcagtggagatggacccagatgacgttaacaaaaacacactgcaagcaaggcaacagacagtgtcagcattggaagacaaacttgcagacttcaagagaagaatggcagatgctgtgtccaggaaaaagatggatactaagcctactgacccgactgggattgaacctgatgaccacctcaaggagcgatcaagtcttaggtatggaaatgtccttgatgtgaatgctattgacatagaagaaccaagtggccaaacagcagattggtatacaattggggtatatgtcataggctttacactccctattatcttaaaggccttatacatgttatcaacacgtgggagacagactgtaaaggaaaataagggaacccgcattcgatttaaggatgacacttcatttgaggacataaatggcattagaagaccaaagcacttgtatgtatccatgcctacagcacaatccaccatgaaagcagaagagttaactcctggacgatttaggaccatagtatgtggcctatttccaactcaaattcaagtgcgaaacataatgagtcctgtgatgggagtcatcgggttttcattttttgttaaggattggacagatcggattagggaatttatggaaaaggaatgcccctttataaaaccagagatgaaaccgggaacaccagcccaagaagctgaattcttaaagaggaataagatatactttatgcagcgtcaagatgtattggataagaatcatgtagctgacattgataagctgattgattatgcagcctcaggagatcctacatcacccgacaatattgagtcccctaatgcaccctgggtgtttgcctgtgcccctgatcgatgcccaccaacatgcatttatgttgcaggaatggcagaactaggtgcatttttttctatattacaggatatgaggaataccatcatggcgtccaaaactgttggcacagctgaagaaaaattaaagaagaagtcatcattttaccagtcatacttgcgaaggacccaatcaatgggaatacagctggaccagagaatcatcttactatatatgcttgaatggggtaaggaaatggtggaccactttcatctgggtgacgatatggaccctgagcttagaggccttgcccaagcacttattgatcagaaagtgaaagagatttccaatcaggaacccttaaaaatatga

SEQ ID NO: 2795 - RNA, 1302 nt, synthetic construct
  misc_feature 1..1302: note = derived and/or modified CDS sequence (wt) from PUUV(PUUV/Croatia_Gerovo/Mg938/2008)__KC676609.1__N
  source 1..1302: mol_type = other RNA
atgagtgatttgacagatatccaagaggatataacccgccatgaacagcaacttgtggttgccagacaaaaactcaaggatgcagagaaggcagtggaaatggacccagatgacgttaacaaaaatacactgcaagcaaggcaacaaacagtgtcagcactggaggacaaactcgcagactttaagcgaagaatggcagatgctgtgtccaggaaaaaaatggatactaagcctactgacccgactgggattgaacctgatgaccatctcaaggagcgatcaagccttaggtatggaaatgtccttgatgtaaatgccattgatatagaagagccaagtggccagacagcagattggtatacaattggagtttatgtcatgggcttcacactcccaatcatactgaaagctctttatatgttatcaacaaggggaagacagactgtgaaagaaaataaagggacacgcatacgttttaaggatgatacatcatttgaggacatcaatggcattagaagaccaaagcatttatatgtatccatgccaacagcccagtcaacgatgaaggcagaagagcttactccaggcaggtttcggacaattgtgtgcggtctcttcccaactcagattcaggtgcgcaatattatgagtcctgtgatgggggttataggattctctttttttgtaaaggactggtcagagagagtaagagattttatggagaaagagtgcccctttataaaaccagagattaaaccaggaacaccccaacaggaggctgagttcttgaaaagaaataaagtgtacttcatgcagcgtcaagatgtgctagataaaaatcatgtggctgacatcgataagttaattgattatgcagcctcaggggacccaacatcacctgacaacatagaatcccctaatgcaccatgggtatttgcatgtgccccagatcggtgtccaccaacatgtatctatgttgcagggatggctgaactaggtgcctttttttcaatccttcaagatatgagaaatactatcatggcatccaaaactgtgggcacagctgaagagaaattgaagaagaaatcatccttttaccagtcttatttgaggaggactcaatcaatgggaatacagcttgaccaaagaatcatcctactttacatgcttgaatggggtaaagaaatggttgatcattttcatcttggtgatgatatggatcctgaactcagaggacttgcacaggcccttattgaccagaaagtgaaggaaatatctaaccaggagcccttaaaaatatga

SEQ ID NO: 2796 - RNA, 1302 nt, synthetic construct
  misc_feature 1..1302: note = derived and/or modified CDS sequence (wt) from PUUV(PUUV/Croatia_Gerovo/Mg979/2008)__KC676613.1__N
  source 1..1302: mol_type = other RNA
atgagtgatttgacagatatccaagaggatataacccgccatgaacagcaacttgtggttgccagacaaaaactcaaggatgcagagaaggcagtggaaatggacccagatgacgttaacaaaaatacactacaagcaaggcaacaaacagtgtcagcactggaggacaaactcgcagactttaagcgaagaatggcagatgctgtgtccaggaaaaaaatggatactaagcctactgacccgactgggattgaacctgatgaccatctcaaggagcgatcaagccttaggtatggaaatgtccttgatgtaaatgccattgatatagaagagccaagtggccagacagcagattggtatacaattggagtttatgtcatcggcttcacactcccaatcatactgaaagctctctacatgttatcaacacggggaagacagactgtgaaagaaaataaagggacacgcatacgttttaaggatgatacatcatttgaggacatcaacggcattagaagaccaaagcatttatatgtatccatgccaacagcccagtcaacgatgaaggcagaagagcttactccaggtaggtttcggacaattgtgtgcggtctcttcccaactcagattcaggtgcgcaatattatgagtcctgtgatgggggtcataggattctctttttttgtaaaggactggtcagagagagtaagagattttatggagaaagagtgcccctttataaaaccagagattaaaccagggacacccccacaggaggctgagttcttgaaaagaaataaagtgtacttcatgcagcgtcaagatgtgctagataaaaatcatgtggcagacattgataagttaattgattatgcagcctcaggggacccaacatcacctgacaacatagaatcccctaatgcaccatgggtatttgcatgtgccccagatcggtgtccaccaacatgtatctatgttgcagggatggctgaactaggtgcctttttttcaatccttcaagatatgagaaatactatcatggcatccaaaactgtgggcacagctgaagagaaattgaagaagaaatcatccttttaccagtcttatttgaggaggactcaatcaatgggaatacagcttgaccaaagaatcatcctactttacatgcttgaatggggtaaagaaatggttgatcattttcatcttggtgatgatatggatcctgaacttagaggacttgcacaggccctcattgaccagaaagtgaaggaaatatctaaccaggagcccttaaaaatatga

SEQ ID NO: 2797 - RNA, 1302 nt, synthetic construct
  misc_feature 1..1302: note = derived and/or modified CDS sequence (wt) from PUUV(PUUV/Konnevesi/Mg_M114B/2005)__JQ319171.1__N
  source 1..1302: mol_type = other RNA
atgagtgacttgacagatatccaagaggatataacccgtcatgaacagcagcttgttgttgccagacaaaaacttaaagatgcagagagagcagtggaagtggacccagatgacgttaacaaaaacacactgcaagccaggcaacaaacagtgtcagcactggaggataaactcgcagactacaagagaagaatggcagatgctgtgtccaggaaaaagatggatactaaacctactgacccgactgggattgaacctgatgatcacctcaaggagagatcaagccttaggtatggaaatgtccttgatgtgaatgcaattgatattgaagaaccaagtggccagacagcagattggtatacaattggagtttatgtgataggattcacactccctatcatccttaaggccttatacatgctttcaacgcgtgggagacagactgtgaaggagaataaaggaacacgtataaggtttaaagatgatacatcatttgaagacatcaacggcataaggaggccaaagcatttatatgtttccatgcctactgcccagtcaaccatgaaggcagaagaactcacaccaggtaggtttcgcacaatagtatgtggtctatttccaactcagatccaagttcgtaacatcatgagtccagtcatgggggttattggtttttcattttttgtgaaagattggccagagagaatcagagagttcatggaaaaggaatgtccgttcattaagccagaagttaaaccaggcacaccggcacaagagattgagatgttgaaaagaaataaaatttactttatgcagcgccaggatgtacttgacaaaaatcatgtggcagacattgataagttgattgactatgcagcctccggtgaccctacatcacctgacaacattgattcccctaatgcaccatgggtatttgcatgtgcaccagaccgatgtccaccaacatgtatttatgttgcagggatggctgagcttggggcctttttttcaatactgcaggacatgagaaatacaataatggcatctaagactgttggcactgctgaagagaagttaaagaaaaagtcctctttctaccagtcttatttacgccggactcaatcaatgggaatccaacttgaccagagaattatcctcttattcatgttggaatggggtaaagagatggtggatcatttccattttggtgatgatatggatccagagctaagaggtcttgcacaggcgctgatagatcaaaaggtgaaggaaatatcaaaccaagagccgttgaaaatataa

SEQ ID NO: 2798 - RNA, 1302 nt, synthetic construct
  misc_feature 1..1302: note = derived and/or modified CDS sequence (wt) from PUUV(PUUV/Konnevesi/Mg_M94A/2005)__JQ319163.2__N
  source 1..1302: mol_type = other RNA
atgagtgacttgacagatatccaagaggatataacccgccatgaacaacagcttgttgttgccagacaaaaacttaaagatgcagagagagcagtggaagtggacccagatgacgttaacaaaaacacactgcaagccaggcaacaaacagtgtcagcactggaggataaactcgcagactacaagagaaggatggcagatgctgtgtccaggaaaaaaatggatactaaacctactgacccgactgggattgaaccggatgatcatctcaaggagagatcaagccttaggtatggaaatgtccttgatgtgaacgcaattgatattgaggaaccaagtggccaaacagcagactggtatacaattggagtttatgtgatagggttcacacttcctatcatccttaaagccttatacatgctttcaacgcgtgggagacaaactgtgaaggaaaataaagggacacgtataaggtttaaggatgatacatcatttgaagacattaatggcataaggaggccaaagcatttatacgtttctatgcccactgctcagtcaaccatgaaggcagaagaactcacaccaggtaggtttcgtacaatagtatgtggtctatttccaactcagattcaagttcgtaatatcatgagtccagttatgggggttatcggtttttcattttttgtgaaagattggccagaaagaattaaagagttcatggaaaaggaatgcccgttcatcaagcctgaagttaaaccaggcacaccagcacaagagattgagatgttgaaaagaaataagatttactttatgcaacgccaggatgtacttgataaaaatcatgtggcagacattgataagttaattgactatgcagcctccggtgaccctacgtcacctgataacattgattcccctaatgcaccatgggtatttgcatgtgcaccagaccgatgtccaccaacatgtatctatgttgcagggatggctgagcttggggcttttttttcaatactgcaggacatgagaaatacaataatggcgtctaagactgttggcacagctgaagaagaagtaaagaaaaagtcctctttctaccaatcttacttacgccggacccaatcaatggggatccaacttgaccaaagaatcatcctattgttcatgttagaatggggtaaagagatggtggatcacttccatcttggtgatgacatggatccagagctcagaggtcttgcacaggcaatgatagaccaaaaggtgaaagaaatatcaaaccaagagccattaaaaatataa

SEQ ID NO: 2799 - RNA, 1302 nt, synthetic construct
  misc_feature 1..1302: note = derived and/or modified CDS sequence (wt) from PUUV(PUUV/Konnevesi/Mg_O14B/2005)__JQ319166.1__N
  source 1..1302: mol_type = other RNA
atgagtgacttgacagatatccaagaggatataacccgccatgaacagcagcttgttgttgccagacaaaaacttaaagatgcagagagagcagtggaagtggacccagatgacgttaacaaaaatacactacaagccaggcaacaaacagtgtcagcactggaggataaactcgcagactacaagagaagaatggcagatgctgtgtccaggaaaaaaatggatactaaacctactgacccgactgggattgaacctgatgatcacctcaaggagagatcaagccttaggtatggaaatgtccttgatgtgaatgcaattgatattgaggaaccaagtggccagacagcagattggtatacaattggagtttatgtgataggattcacactccctatcatccttaaggccttatacatgctttcaacgcgtgggagacaaactgtaaaggagaataaagggacacgtataaggtttaaagatgatacatcatttgaagacatcaacggcataaggaggccaaagcatttatatgtttccatgcctactgcccagtcaaccatgaaggcagaagaactcacaccgggtaggtttcgcacaatagtatgtggtctatttccaactcagatccaagttcgtaacatcatgagtccagtcatgggggttattggtttttcattttttgtaaaagattggccagagagaatcagagagttcatggaaaaggaatgcccgttcattaagccagaagttaaaccaggcacaccggcacaagagattgagatgttgaaaagaaataaaatttactttatgcagcgccaggatgtacttgacaaaaatcatgtggcagacattgataagttgattgactatgcagcctccggtgaccctacatcacctgacaacattgattcccctaatgcgccatgggtatttgcatgtgcaccagaccgatgtccaccaacatgtatttatgttgcagggatggctgagcttggggcctttttttcaatactccaggacatgagaaatacaataatggcatctaagactgttggcactgctgaagagaagttaaagaaaaagtcctctttctaccagtcttacttacgccggactcaatcaatgggtattcaacttgaccagagaattatcctcttgttcatgttggaatggggcaaagagatggtggatcatttccatctcggtgatgacatggatccagagctcagaggtcttgcacaagcactgatagatcaaaaggtgaaggaaatatcaaaccaggagccattgaaaatataa

SEQ ID NO: 2800 - RNA, 1302 nt, synthetic construct
  misc_feature 1..1302: note = derived and/or modified CDS sequence (wt) from PUUV(PUUV/Konnevesi/Mg_O22B/2005)__JQ319168.2__N
  source 1..1302: mol_type = other RNA
atgagtgacttgacagatatccaagaggatataacccgccatgaacagcagcttgttgttgccagacaaaaacttaaagatgcagagagagcagtggaagtggacccagatgacgttaacaaaaatacactgcaagccaggcaacaaacagtgtcagcactggaggataaactcgcagactacaagagaagaatggcagatgctgtgtccaggaaaaaaatggatactaaacctactgacccgactgggattgaacctgatgatcacctcaaggagagatcaagccttaggtatggaaatgtccttgatgtgaatgcaattgatattgaggaaccaagtggccagacagcagattggtatacaattggagtttatgtgataggattcacactccctatcatccttaaggccttatacatgctttcaacgcgtgggagacaaactgtaaaggagaataaagggacacgtataaggtttaaagatgatacatcatttgaagacatcaacggcataaggaggccaaagcatttatatgtttccatgcctactgcccagtcaaccatgaaggcagaagaactcacaccgggtaggtttcgcacaatagtatgtggtctatttccaactcagatccaagttcgtaacatcatgagtccagtcatgggggttattggtttttcattttttgtaaaagattggccagagagaatcagagagttcatggaaaaggaatgcccgttcattaagccagaagttaaaccaggcacaccggcacaagagattgagatgttgaaaagaaataaaatttactttatgcagcgccaggatgtacttgacaaaaatcatgtggcagacattgataagttgattgactatgcagcctccggtgaccctacatcacctgaaaacattgattcccctaatgcgccatgggtatttgcatgtgcaccagaccgatgtccaccaacatgtatttatgttgcagggatggctgagcttggggcctttttttcaatactccaggacatgagaaatacaataatggcatctaagactgttggcactgctgaagagaagttaaagaaaaagtcctctttctaccagtcttacttacgccggactcaatcaatgggtattcaacttgaccagagaattatcctcttgttcatgttggaatggggcaaagagatggtggatcatttccatctcggtgatgacatggatccagagctcagaggacatgcacaagcactgatagatcaaaaggtgaaggaaatatcaaaccaggagccattgaaaatataa

SEQ ID NO: 2801 - RNA, 1302 nt, synthetic construct
  misc_feature 1..1302: note = derived and/or modified CDS sequence (wt) from PUUV(PUUV/Konnevesi/Mg_O57A/2005)__JQ319161.2__N
  source 1..1302: mol_type = other RNA
atgagcgacttgacagatatccaagaggatataacccgccatgaacaacagcttgttgttgccagacaaaaacttaaagatgcagagagagcagtggaagtggacccagatgacgttaacaaaaacacactgcaagccaggcaacaaacagtgtcagcactggaggataaactcgcagactacaagagaaggatggcagatgctgtgtccaggaaaaaaatggatactaaacctactgacccgactgggattgaaccggatgatcatctcaaggagagatcaagccttaggtatggaaatgtccttgatgtgaacgcaattgatattgaggaaccaagtggccaaacagcagactggtatacaattggagtttatgtgataggattcacacttcctatcatccttaaagccttatacatgctttcaacgcgtgggagacaaactgtgaaggaaaataaagggacacgtataaggtttaaggatgatacatcatttgaagacattaatggcataaggaggccaaagcatttatacgtttctatgcccactgctcagtcaaccatgaaggcagaagaactcacaccaggtaggtttcgtacaatagtatgtggtctatttccaactcggattcaagttcgtaatatcatgagtccagttatgggggttatcggtttttcattttttgtgaaagattggccagaaagaattaaagagttcatggaaaaggaatgctcgttcattaagcctgaagttaaaccaggcacaccggcacaagagattgagatgttgaaaagaaataagatttactttatgcaacgccaggatgtacttgataaaaatcatgtggcagacattgataagttaattgactatgcagcctccggtgaccctacgtcacctgataacattgattcccctaatgcaccatgggtatttgcatgtgcaccagaccgatgtccaccaacatgtatctatgttgcagggatggctgagcttggggcttttttttcaatactgcaggacatgagaaatacaataatggcgtctaagactgttggcacagctgaagaagaagtaaagaaaaagtcctctttctaccaatcttacttacgccggactcaatcaatggggatccaacttgaccaaagaatcatcctattgttcatgttagaatggggtaaagagatggtggatcacttccatcttggtgatgacatggatccagagctcagaggtcttgcacaggcattgatagaccaaaatgtgaaagaaatatcaaaccaagagccattaaaaatataa

SEQ ID NO: 2802 - RNA, 1302 nt, synthetic construct
  misc_feature 1..1302: note = derived and/or modified CDS sequence (wt) from PUUV(PUUV/Konnevesi/Mg_O6B/2005)__JQ319164.1__N
  source 1..1302: mol_type = other RNA
atgagtgacttgacagatatccaagaggatataacccgccatgaacagcagcttgttgttgccagacaaaaacttaaagatgcagagagagcagtggaagtggacccagatgacgttaacaaaaatacactgcaagccaggcaacaaacagtgtcagcactggaggataaactcgcagactacaagagaagaatggcagatgctgtgtccaggaaaaaaatggatactaaacctactgacccgactgggattgaacctgatgatcacctcaaggagagatcaagccttaggtatggaaatgtccttgatgtgaatgcaattgatattgaggaaccaagtggccagacagcagattggtatacaattggagtttatgtgataggattcacactccctatcatccttaaggccttatacatgctttcaacgcgtgggagacaaactgtaaaggagaataaagggacacgtataaggtttaaagatgatacatcatttgaagacatcaacggcataaggaggccaaagcatttatatgtttccatgcctactgcccagtcaaccatgaaggcagaagaactcacaccgggtaggtttcgcgcaatagtatgtggtctatttccaactcagatccaagttcgtaacatcatgagtccagtcatgggggttattggtttttcattttttgtaaaagattggccagagagaatcagagagttcatgggaaaggaatgcccgttcattaagccagaagttaaaccaggcacaccggcacaagagattgagatgttgaaaagaaataaaatttactttatgcagcgccaggatgtacttgacaaaaatcatgtggcagacattgataagttgattgactatgcagcctccggtgaccctacatcacctgacaacattgattcccctaatgcgccatgggtatttgcatgtgcaccagaccgatgtccaccaacatgtatttatgttgcagggatggctgagcttggggcctttttttcaatactccaggacatgagaaatacaataatggcatctaagactgttggcactgctgaagagaagttaaagaaaaagtcctctttctaccagtcttacttacgccggactcaatcaatgggtattcaacttgaccagagaattatcctcttgttcatgttggaatggggcaaagagatggtggatcatttccatctcggtgatgacatggatccagagctcagaggtcttgcacaagcactgatagatcaaaaggtgaaggaaatatcaaaccaggagccattgaaaatataa

SEQ ID NO: 2803 - RNA, 1302 nt, synthetic construct
  misc_feature 1..1302: note = derived and/or modified CDS sequence (wt) from PUUV(PUUV/Konnevesi/Mg_O74B/2005)__JQ319170.1__N
  source 1..1302: mol_type = other RNA
atgagtgacttgacagatatccaagaggatataacccgccatgaacagcagcttgttgttgccagacaaaaacttaaagatgcagagagagcagtggaagtggacccagatgacgttaacaaaaatacactacaagccaggcaacaaacagtgtcagcactggaggataaactcgcagactacaagagaagaatggcagatgctgtgtccaggaaaaaaatggatactaaacctactgacccgactgggattgaacctgatgatcacctcaaggagagatcaagccttaggtatggaaatgtccttgatgtgaatgcaattgatattgaggaaccaagtggccagacagcagattggtatacaattggagtttatgtgataggattcacactccctatcatccttaaggccttatacatgctttcaacgcgtgggagacaaactgtaaaggagaataaagggacacgtataaggtttaaagatgatacatcatttgaagacatcaacggcataaggaggccaaagcatttatatgtttccatgcctactgcccagtcaaccatgaaggcagaagaactcacaccgggtaggtttcgcacaatagtatgtggtctatttccaactcagatccaagttcgtaacatcatgagtccagtcatgggggttattggtttttcattttttgtaaaagattggccagagagaatcagagagttcatggaaaaggaatgcccgttcattaagccagaagttaaaccaggcacaccggcacaagagattgagatgttgaaaagaaataaaatttactttatgcagcgccaggatgtacttgacaaaaatcatgtggcagacattgataagttgattgactatgcagcctcgggtgaccctacatcacctgacaacattgattcccctaatgcgccatgggtatttgcatgtgcaccagaccgatgtccaccaacatgtatttatgttgcagggatggctgagcttggggcttttttttcaatactccaggacatgagaaatacaataatggcatctaagactgttggcactgttgaagagaagttaaagaaaaagtcctctttctaccagtcttacttacgccggactcaatcaatgggtattcaacttgaccagagaattatcctcttgttcatgttggaatggggcaaggagatggtggatcatttccatctcggtgatgacatggatccagagctcagaggtcttgcacaagcactgatagatcaaaaggtgaaggaaatatcaaaccaggagccattgaaaatataa

SEQ ID NO: 2804 - RNA, 1302 nt, synthetic construct
  misc_feature 1..1302: note = derived and/or modified CDS sequence (wt) from PUUV(PUUV/Konnevesi/Mg_O78A/2005)__JQ319162.2__N
  source 1..1302: mol_type = other RNA
atgagtgacttgacagatatccaagaggatataacccgccatgaacagcagcttgttgttgccagacaaaaacttaaagatgcagagaaagcagtggaagtggacccagatgacgttaacaaaaacacactgcaagccaggcaacaaacagtgtcagcactggaagataaactcgcagactacaagagaaggatggcagatgctgtgtccaggaaaaaaatggatactaaacctactgacccgactgggattgaaccagatgatcacctcaaggagagatcaagccttaggtatggaaatgtccttgatgtgaacgcaattgatattgaggaaccaagtggccaaacagcagactggtatacaattggagtttatgtgatagggttcacacttcctatcatccttaaagccttatacatgctatcaacgcgtgggagacaaactgtgaaggaaaataaagggacacgtataaggtttaaggatgatacatcatttgaagacattaatggcataaggaggccaaagcatttatacgtttctatgcccactgcccagtcaaccatgaaggcagaagaactcacaccaggtaggtttcgcacaatagtatgtggtctatttccaactcagatccaagttcgtaacatcatgagtccagttatgggggttatcggtttttcattttttgtgaaagattggccagagagaattagagagttcatggaaaaggaatgcccgttcatcaagcctgaagttaaaccaggcacaccagcacaagagattgagatgttgaaaagaaataagatttactttatgcagcgccaggatgtacttgataaaaatcatgtggcagacattgataagttaattgactatgcagcctctggtgaccctacgtcacctgataacattgattcccctaatgcaccatgggtattggcatgtggaccagaacgatgcccaccaacatgtatctatgttgcagggatggctgagcttggggcttttttttcaattctgcaggacatgagaaatacaataatggcgtctaagaccgtcggctcagatgaagtgaaattaaagaaaaagtcctttttttaccaatattacttacgccggactcactcaatggggatccaacttgaccagagaatcatcctattatgcatgttagagtggggtatagagatggtggatcacttccatcttggtgatgacatggatccagagctcagaggtcttgcgcaggcaatgatagaccaaaaggtgaaggaaatatcaaaccaagagccattaataatataa

SEQ ID NO: 2805 - RNA, 1302 nt, synthetic construct
  misc_feature 1..1302: note = derived and/or modified CDS sequence (wt) from PUUV(PUUV/Mg23/HungaryTR17/00)__FN377822.1__N
  source 1..1302: mol_type = other RNA
atgagtgacttgacagatatccaagaggatataacccgccatgaacagcaacttgttgttgccagacagaaactcaaggatgcagagaaggcagtggaaatggacccagatgacgttaacaaaaatacactgcaagcaaggcaacaaacagtgtcagcattggaggacaaactcgcagactttaagcggagaatggcagatgctgtgtccaggaaaaaaatggatactaagcctactgacccgactgggattgaacctgatgaccacctcaaggagcgatcaagccttaggtatggaaatgtccttgatgtgaatgccattgatatagaagagccgagtggtcaaacagcagactggtatacaattggagtttatgtcattggctttacactcccgattatactgaaggcactttatatgttatcaacacgaggaaggcagactgtaaaagaaaataaaggaacacgcatacgttttaaggatgatacatcatttgaggacatcaatggcattagaagaccaaagcatttatatgtatccatgccaacagcccagtcaacaatgaaggcagaagagcttactcctggcaggttccggacaattgtgtgtggtctcttcccaactcaaattcaagtgcgcaatattatgagtcctgtgatgggggttataggattctctttctttgtaaaggattggtcagagagggtgagagaatttatggagaaagaatgcccttttataaaaccagagattaaaccagggacacccccgcaggaggctgagttcttaaaaagaaataaggtatacttcatgcagcgtcaagatgtgctagataaaaatcatgtggcggatattgataagttgattgattacgcagcctcaggggacccaacatcacctgacaacatagaatcccctaatgcaccatgggtatttgcatgtgctccagataggtgtccaccaacatgcatctatgttgcagggatggctgaacttggtgcctttttttcaatccttcaggatatgagaaatactataatggcatccaagactgtgggcacagctgaagaaaaattgaagaagaaatcatccttttatcagtcttacttgaggaggactcaatcaatggggatacagcttgaccaaagaattatcctcctatacatgcttgaatggggcaaggaaatggttgatcattttcatcttggtgatgatatggatcctgaactcagaggacttgcacaggctctcattgaccagaaagtgaaggaaatatctaaccaggagcccttaaaaatatga

SEQ ID NO: 2806 - RNA, 1302 nt, synthetic construct
  misc_feature 1..1302: note = derived and/or modified CDS sequence (wt) from PUUV(PUUV/Mg9/HungaryTR17/00)__FN377821.1__N
  source 1..1302: mol_type = other RNA
atgagtgacttggcagatatccaagaggatataacccgccatgaacagcaacttgttgttgccagacagaaacttaaggatgcagagaaggcagtggaaatggacccagatgacgttaacaaaaatacactgcaagcaaggcaacaaacagtgtcagcattggaggacaaactcgcagactttaagcgaagaatggcagatgctgtgtccaggaaaaagatggatactaagcctactgacccgactgggattgaacctgatgaccacctcaaggagcgatcaagccttaggtatggaaatgtccttgatgtaaatgccattgatatagaagagccaagtggtcaaacagcagactggtatacaattggagtttatgtcattggctttacactcccgattatactgaaggcactctatatgttatcaacacgaggaagacagactgtgaaggaaaataaaggaacacgcatacgtttcaaggatgatacatcatttgaggacattaatggcattaggagaccaaagcatttatatgtatccatgccaacagcccagtccacaatgaaggcagaagagcttactcctggcaggttccggactattgtgtgtggtctcttcccaactcaaattcaggtgcgtaatattatgagtcctgtgatgggggttataggattctctttttttgtaaaggattggtcagagagggtgagagaatttatggagaaagaatgcccctttataaaaccagagattaagccagggacacccccgcaggaggctgagttcttaaaaagaaataaggtgtacttcatgcagcgtcaagatgtgctagataaaaatcatgtggcagatattgataagttgattgattacgcagcctcaggggacccaacatcccctgacaacatagaatcccctaatgcaccatgggtatttgcatgtgctccagataggtgtccaccaacatgcatctatgttgcagggatggctgaacttggtgcctttttttcgatccttcaagatatgagaaatactataatggcatccaagactgtgggcacagctgaagaaaaactgaagaagaaatcatccttttatcagtcttacttgaggaggactcaatcaatggggatacagcttgaccaaagaatcatcctcctatacatgcttgaatggggtaaggaaatggttgatcattttcatcttggtgatgatatggatcctgaactcagagggcttgcacaggccctcattgaccagaaagtgaaggagatatctaaccaggagcccttgaaaatatga

SEQ ID NO: 2807 - RNA, 1302 nt, synthetic construct
  misc_feature 1..1302: note = derived and/or modified CDS sequence (wt) from PUUV(PUUV/NL/Mg1012/2010)__KU314900.1__N
  source 1..1302: mol_type = other RNA
atgagtgacttaacagacattcaagaggatataacccgccatgaacaacaacttgtggttgccaggcaaaaactcaaggatgcagagaaggcagtggagatggacccagatgacgttaacaaaaacacactgcaagcaaggcaacagacagtgtcagcattggaagataaacttgcagactacaagcggagaatggcagatgctgtgtccaggaaaaaaatggatactaaacctactgatccgactgggattgaacctgatgatcacctcaaagagcgatcaagcctcagatatggaaatgtccttgatgtaaatgccatcgatatagaagagcctagtggtcaaacagcagattggtatacaattggagtttatgtcattggtttcacacttcctatcatcctaaaggccttatacatgttgtcaacacgtggaagacaaactgtaaaagagaataaagggactcgtattcggtttaaagatgatacctcgtttgaggacattaatggtattagaagaccaaaacatttgtatgtgtccatgccaactgctcaatcaactatgaaggctgaagagctaactcctggtcgattcaggactattgtatgtggcttattcccaactcagatccaagtgcgaaacataatgagtcctgtgatgggggttataggcttttcattctttgtcaaggattggccagatcggattagggaatttatggaaaaggaatgccctttcatcaagccagaagtcaagccagggacaccggcacaagaggctgaattcctaaaaaggaataaagtatattttatgcagagacaggatgtactagataaaaatcatgtggctgatattgataaactaattgattatgcagcttcaggagaccccacatcaccagacaacattgaatctcctaatgcaccatgggtatttgcctgtgcccctgatcgatgcccaccgacatgtatttatgttgcaggtatggcagaattaggtgcatttttctctatactccaggatatgaggaacactatcatggcatctaagactgttggggcagctgaggagaagttaaaaaagaagtcatcattttaccaatcttatttgagaagaactcaatcaatgggaatacaactagaccaaagaattatcttactatatatgcttgagtggggtaaagaaatggtagaccatttccacttgggtgatgatatggatcctgaacttagaggccttgcccaagcacttattgaccaaaaagtgaaagaaatatccaatcaagagcctctaaaaatttaa

SEQ ID NO: 2808 - RNA, 1302 nt, synthetic construct
  misc_feature 1..1302: note = derived and/or modified CDS sequence (wt) from PUUV(PUUV/NL/Mg1439/2011)__KU314901.1__N
  source 1..1302: mol_type = other RNA
atgagtgacttaacagacattcaagaggatataacccgccatgaacaacaacttgtggttgccaggcaaaagctcaaggatgcagagaaggcagtggagatggacccagatgacgttaacaaaaacacactgcaagcaaggcaacagacagtgtcagcattggaagataaacttgcagactacaagcggagaatggcagatgctgtgtccaggaaaaaaatggatactaaacctactgatccgactgggattgaacctgatgatcacctcaaagagcgatcaagcctcagatatggaaatgtccttgatgtaaatgccatcgatatagaagagcctagtggtcaaacagcagattggtatacaattggagtttatgtcattggtttcacacttcctatcatcctaaaggccttatacatgttgtcaacacgtggaagacaaactgtaaaagagaataaaggggctcgtattcggtttaaagatgatacctcgtttgaggacattaatggtattagaagaccaaaacatttgtatgtgtccatgccaactgctcaatcaactatgaaggctgaagagctaactcctggtcgattcaggactattgtatgtggcttattcccaactcagatccaagtgcgaaacataatgagtcctgtgatgggggttataggcttttcattctttgtcaaggattggccagatcggattagggaatttatggaaagggaatgccctttcatcaagccagaagtcaagccagggacaccggcacaagaggctgaattcctaaaaaggaataaagtatattttatgcagagacaggatgtactagataaaaatcatgtggctgatattgatgaactaattgattatgcagcttcaggagaccccacatcaccagacaacattgaatctcctaatgcaccatgggtatttgcctgtgcccctgatcgatgcccaccgacatgtatttatgttgcaggtatggcagaattaggtgcatttttctctatactccaggatatgaggaacactatcatggcatctaagactgttgggacagctgaggagaagttaaaaaagaagtcatcattttaccaatcttatttgagaagaactcaatcaatgggaatacaactagaccaaagaattatcttactatatatgcttgagtggggtaaagaaatggtagaccatttccacttgggtgatgatatggatcctgaacttagaggccttgcccaagcacttattgaccaaaaagtgaaagaaatatccaatcaagagcctctaaaaatttaa

SEQ ID NO: 2809 - RNA, 1302 nt, synthetic construct
  misc_feature 1..1302: note = derived and/or modified CDS sequence (wt) from PUUV(PUUV/NL/Mg2/2008)__KU314902.1__N
  source 1..1302: mol_type = other RNA
atgagtgacttgacagacattcaggaggatataactcgccatgaacaacaacttgtggttgccagacaaaagctcaaggatgcggaaaaggcagtggagatggacccagatgacgttaacaaaaccacattacaagcaaggcaacagacagtgtcagcactggaggacaaacttgcagatttcaagcgacaaatggcagatgctgtctcaaggaaaaagatggatactaaaccagctgacccgactgggattgagcctgatgatcatctcaaggagcgatcaagcctcagatatgggaatgtccttgatgtaaatgccattgatatagaggaaccaagtggtcaaacagcagactggtatacaattggagtatatgtcataggctttacacttcctattatcctgaaggctttgtatatgttgtcaacacgtgggagacaaaccgtgaaagaaaacaaagggactcgcattcgtttcaaagacgacacttcttttgaggacatcaatggcatcaggagaccaaagcacctatatgtttctatgcccactgctcaatcaaccatgaaggctgaagaactgacccctgggcgatttagaaccatagtatgtggtctattcccaactcaaattcaagtgcgcaacataatgagtcctgtaatgggagtcattggcttctctttttttgttaaggactgggcagatcggattagggaattcatggaaaaagaatgcccttttatcaaaccagatgtaaagccagggacaccagcccaggaagctgaattcttaaagaggaataaaatatactttatgcaaagacaagaagtactggataaaaatcatgttgctgatattgataagttgattgactatgcagcttcaggagatccaacatcaccggataacattgagtccccaaattcaccctgggtgtttgcctgtgcacccgatcggtgcccaccaacatgtatctatgttgcagggatggctgaactaggtgcattcttttccatattacaagatatgagaaataccatcatggcatctaaaactgttggcacagcagaagaaaagttaaaaaagaagtcatcattctatcaatcatacctgcggagaacacaatcaatgggaatacagctcgaccaaagaattatcttattgtacatgctggaatggggcaaagaaatggttgatcattttcaccttggtgatgacatggatcctgaacttaggggccttgcacaggcacttattgatcaaaaagtagaggaaatatctaaccaggagcccttaaagatatga

SEQ ID NO: 2810 - RNA, 1302 nt, synthetic construct
  misc_feature 1..1302: note = derived and/or modified CDS sequence (wt) from PUUV(PUUV/NL/Mg25/2007)__KU314897.1__N
  source 1..1302: mol_type = other RNA
atgagtgacttaacagacattcaagaggatataacccgccatgaacaacaacttgtggttgccaggcaaaaactcaaggatgcagagaaggcagtggagatggacccagatgacgttaacaaaaacacactgcaagcaaggcaacagacagtgtcagcattggaagataaacttgcagactacaagcggagaatggcagatgctgtgtccaggaaaaaaatggatactaaacctactgatccgactgggattgaacctgatgatcacctcaaagagcgatcaagcctcagatatggaaatgtccttgatgtaaatgccatcgatatagaagagcctagtggtcaaacagcagattggtatacaattggagtttatgtcattggtttcacacttcctatcatcctaaaggccttatacatgttgtcaacacgtggaagacaaactgtaaaagagaataaagggactcgtattcggtttaaagatgatacctcgtttgaggacattaatggtattagaagaccaaaacatttgtatgtgtccatgccaactgctcaatcaactatgaaggctgaagagctaactcctggtcgattcaggactattgtatgtggcttattcccaactcagatccaagtgcgaaacataatgagtcctgtgatgggggttataggcttttcattctttgtcaaggattggccagatcggattagggaatttatggaaaaggaatgccctttcatcaagccagaagtcaagccagggacaccggcacaagaggctgaattcctaaaaaggaataaagtatattttatgcagagacaggatgtactagataaaaatcatgtggctgatattgataaactaattgattatgcagcttcaggagaccccacatcaccagacaacattgaatctcctaatgcaccatgggtatttgcctgtgcccctgatcgatgcccaccgacatgtatttatgttgcaggtatggcagaattaggtgcatttttctctatactccaggatatgaggaacactatcatggcatctaagactgttgggacagctgaggagaagttaaaaaagaagtcatcattttaccaatcttatttgagaagaactcaatcaatgggaatacaactagaccaaagaattatcttactatatatgcttgagtggggtaaagaaatggtagaccatttccacttgggtgatgatatggatcctgaacttagaggccttgcccaagcacttattgaccaaaaagtgaaagaaatatccaatcaagagcctctaaaaatttaa

SEQ ID NO: 2811 - RNA, 1302 nt, synthetic construct
  misc_feature 1..1302: note = derived and/or modified CDS sequence (wt) from PUUV(PUUV/NL/Mg31/2007)__KU314896.1__N
  source 1..1302: mol_type = other RNA
atgagtgacttaacagacattcaagaggatataacccgccatgaacaacaacttgtggttgccaggcaaaaactcaaggatgcagagaaggcagtggagatggacccagatgacgttaacaaaaacacactgcaagcaaggcaacagacagtgtcagcattggaagataaacttgcagactacaagcggagaatggcagatgctgtgtccaggaaaaaaatggatactaaacctactgatccgactgggattgaacctgatgatcacctcaaagagcgatcaagcctcagatatggaaatgtccttgatgtaaatgccatcgatatagaagagcctagtggtcaaacagcagattggtatacaattggagtttatgtcattggtttcacacttcctatcatcctaaaggccttatacatgttgtcaacacgtggaagacaaactgtaaaagagaataaagggactcgtattcggtttaaagatgatacctcgtttgaggacattaatggtattagaagaccaaaacatttgtatgtgtccatgccaactgctcaatcaactatgaaggctgaagagctaactcctggtcgattcaggactattgtatgtggcttattcccaactcagatccaagtgcgaaacataatgagtcctgtgatgggggttataggcttttcattctttgtcaaggattggccagatcggattagggaatttatggaaaaggaatgccctttcatcaagccagaagtcaagccagggacaccggcacaagaggctgaattcctaaaaaggaataaagtatattttatgcagagacaggatgtaccagataaaaatcatgtggctgatattgataaactaattgattatgcagcttcaggagaccccacatcaccagacaacattgaatctcctaatgcaccatgggtatttgcctgtgcccctgatcgatgcccaccgacatgtatttatgttgcaggtatggcagaattaggtgcatttttctctatactccaggatatgaggaacactatcatggcatctaagactgttgggacagctgaggagaagttaaaaaagaagtcatcattttaccaatcttatttgagaagaactcaatcaatgggaatacaactagaccaaagaattatcttactatatatgcttgagtggggtaaagaaatggtagaccatttccacttgggtgatgatatggatcctgaacttagaggccttgcccaagcacttattgaccaaaaagtgaaagaaatatccaatcaagagcctctaaaaatttaa

SEQ ID NO: 2812 - RNA, 1302 nt, synthetic construct
  misc_feature 1..1302: note = derived and/or modified CDS sequence (wt) from PUUV(PUUV/NL/Mg502/2008)__KU314904.1__N
  source 1..1302: mol_type = other RNA
atgagtgacttgacagacattcaggaggatataactcgccatgaacaacaacttgtggttgccagacaaaagctcaaggatgcagaaaaggcagtggagatggacccagatgacgttaacaaaaacacattacaagcaaggcaacagacagtgtcagcactggaggacaaacttgcagatttcaagcgacaaatggcagatgctgtctcaaggaaaaagatggatactaaaccagctgacccgactgggattgagcctgatgatcatctcaaggagcgatcaagcctcagatatgggaatgtccttgatgtaaatgccattgatatagaggaaccaagtggtcaaacagcagactggtatacaattggagtatatgtcataggctttacacttcctattatcctgaaggctttgtatatgttgtcaacacgtgggagacaaaccgtgaaagaaaacaaagggactcgcattcgtttcaaagacgacacttcttttgaggacatcaatggcatcaggagaccaaagcacctatatgtttctatgcccactgctcaatcaaccatgaaggctgaagaactgacccctgggcgatttagaaccatagtatgtggtctattcccaactcaaattcaagtgcgcaacataatgagtcctgtaatgggagtcattggcttctctttttttgttaaggactgggcagatcggattagggaattcatggaaaaagaatgcccttttatcaaaccagatgtaaagccagggacaccagcccaggaagctgaattcttaaagaggaataaaatatactttatgcaaagacaagaagtactggataaaaatcatgttgctgatattgataagttgattgactatgcagcttcaggagatccaacatcaccggataacattgagtccccagattcaccctgggtgtttgcctgtgcacccgatcggtgcccaccaacatgtatctatgttgcagggatggctgaactaggtgcattcttttccatattacaagatatgagaaataccatcatggcatctaaaactgttggcacagcagaagaaaagttaaaaaagaagtcatcattctatcaatcatacctgcggagaacacaatcaatgggaatacagctcgaccaaagaattatcttattgtacatgctggaatggggcaaagaaatggttgatcattttcaccttggtgatgacatggatcctgaacttaggggccttgcacaggcacttattgatcaaaaagtaaaggaaatatctaaccaggagcccttaaagatatga

SEQ ID NO: 2813 - RNA, 1302 nt, synthetic construct
  misc_feature 1..1302: note = derived and/or modified CDS sequence (wt) from PUUV(PUUV/NL/Mg591/2008)__KU314905.1__N
  source 1..1302: mol_type = other RNA
atgagcgacttgacagacattcaggaagatataacccgccatgaacaacaacttgtggttgccagacaaaagctcaaggatgcagaaaaggcggtggagatggacccagatgacgttaacaaaaacacactacaagcaaggcaacagacagtgtcagcactggaggacaaacttgcagatttcaagcgacaaatggcagatgctgtctcaaggaaaaagatggatactaagcctactgacccgactgggattgagcctgatgatcatctcaaggagcgatcaagcctcagatatgggaatgtccttgatgtaaatgccattgatatagaggaaccaagtggtcaaacagcagactggtatacaattggagtatatgtcataggctttacacttcctattatcctgaaggctctgtatatgctgtcaacacgcgggagacaaactgtgaaagaaaacaaaggaactcgcattcgtttcaaagatgacacttcttttgaggacatcaatggcatcaggagaccaaagcacctgtatgtttccatgcccactgctcaatcaaccatgaaggctgaagaactgacccctgggcgatttagaactatagtatgtggtctattcccaactcaaattcaagtgcgcaacataatgagtcctgtaatgggagtcattggcttctctttttttgttaaggactgggcagatcggattagggaattcatggaaaaagaatgcccctttatcaaaccagatgtgaagccagggacaccagcccaggaagctgaattcttaaagaggaataaaatatactttatgcaaagacaagaagtactggataaaaatcatgttgctgatattgataagttgattgattatgcagcttcaggagatccaacatcaccagataacattgagtccccaaattcaccctgggtgtttgcctgtgcacccgatcggtgcccaccaacatgtatctatgttgcagggatggctgagctaggtgcattcttttccatattacaggatatgagaaataccatcatggcatctaaaactgttggcacagcagaagaaaagttaaaaaagaaatcatcattttatcaatcatacctgcgaagaacacaatcaatgggaatacagcttgaccaaagaattatcttattgtacatgctggaatggggcaaagaaatggttgatcattttcaccttggcgatgacatggatcctgaacttaggagccttgcacaggcacttattgatcaaaaagtaaaggaaatatctaaccaggagcccttaaagatatga

SEQ ID NO: 2814 - RNA, 1302 nt, synthetic construct
  misc_feature 1..1302: note = derived and/or modified CDS sequence (wt) from PUUV(Samara_49/CG/2005)__AB433843.2__N
  source 1..1302: mol_type = other RNA
atgagtgacttgacagacatccaagaggagataacccgccatgagcaacaacttgttgttgccagacaaaaactcaaggatgcagagagagcagtggaagtggacccggatgacgttaacaaaaacacactacaagcaaggcaacaaacagtgtcagcattggaggataaactcgcagactacaagagaagaatggcagatgctgtgtcccggaagaaaatggatactaaacctactgacccgactgggattgaacctgatgaccatctcaaggagagatccagccttagatatggaaatgtccttgatgtaaatgccattgacattgaggaaccaagtggtcagacagcagattggtatactattggagtctatgtgatagggttcacaattcccatcattttaaaggctttatacatgttgtcaacacgtggaagacaaaccgtaaaagaaaataaaggaacacggatcaggttcaaggatgacacatcatttgaggatattaatggcatcaggaggccaaaacatctatatgtatccatgcctacagctcagtccaccatgaaggctgaagaactcacacccggaaggtttcgtacaatagtatgtggcttattccctacacagatacaagtgcgtaacatcatgagtccagtgatgggagtgattggtttttctttctttgttaaagactggccagaaagaattagggagtttatggaaagggaatgccctttcataaagccagaagttaagcctgggacaccagcacaggaggtagaatttttgaaaagaaatagagtttatttcatgacccgccaagatgttcttgataaaaatcatgtggctgacattgacaagttaattgactatgctgcctctggtgaccctacatcacctgatgacatcgaatcccctaatgcaccatgggtatttgcctgtgcaccagatcggtgtcccccaacatgtatttacgttgctgggatggctgaattaggcgcatttttttctatcctacaagatatgaggaacactattatggcatctaagactgtaggcacagcagaagaaaaattaaagaagaaatcttccttctatcagtcatatttgcgccggacacaatcgatgggaattcaacttgatcagaggataatcttactgtacatgttggagtggggaaaagaaatggtggatcatttccatcttggtgatgatatggatcctgagctaaggggccttgcccagtcactcatcgatcagaaggtaaaagagatatcaaaccaagagcccttaaagatatga

SEQ ID NO: 2815 - RNA, 1302 nt, synthetic construct
  misc_feature 1..1302: note = derived and/or modified CDS sequence (wt) from PUUV(Thuin/33Cg/96)__AJ277030.1__N
  source 1..1302: mol_type = other RNA
atgagtgacttgacagacattcaggaggatataacccgccatgaacaacaacttgttgttgccagacagaaactcaaggatgcagaaaaggcggtggagatggacccagatgacgttaacaaaaacacattgcaagcaaggcaacagacagtgtcagcactggaggacaaacttgcagacttcaagcgacaaatggcagatgctgtgtccaggaaaaaaatggatactaaacctactgatccgactgggattgagcctgatgaccatctcaaggaacgatcaagcctcagatatgggaatgtccttgatgtaaatgccattgatatagaagaaccaagtggtcaaacagcagattggtatacaattggagtgtatgttataggctttacacttcctattatcctgaaggctttatatatgttgtcaacacgtgggagacaaactgtgaaagaaaacaaagggactcgtatccgtttcaaagatgacacttccttcgaggacatcaatggtatcaggagaccgaagcacctatatgtttctatgcctactgcgcaatcaactatgaaggctgaagaattgacccctgggcgatttagaaccatagtatgcggtctatttccaactcaaattcaagtacgcaacataatgagccctgtaatgggagtcattggtttttctttttttgtcaaggactgggcagatcggattagggaatttatggaaaaagaatgcccttttatcaaaccagaggtaaagccaggaacaccagtccaggaagctgaattcctaaagagaaacaaaatatacttcatgcagaggcaggaagtactggataaaaaccatgttgctgatattgataagttgattgactatgcagcctcaggagatccaacatcaccagataacattgaagccccaaatgcaccctgggtgtttgcctgtgcgcccgaccggtgcccacctacatgtatttatgttgcagggatggctgaattaggtgcattcttttccatattacaggatatgagaaataccatcatggcatctaaaactgttgggacagcagaagaaaagttaaaaaagaaatcatcattttatcaatcatacctgcggaggactcagtcaatgggaatacagcttgaccaaagaattatcttattgtatatgcttgaatggggcaaagaaatggtggatcatttccaccttggcgatgatatggatcctgaacttaggggccttgcacaggcgcttattgatcaaaaagtgaaggaaatctccaaccaggagcctttaaagatatga

SEQ ID NO: 2816 - RNA, 1302 nt, synthetic construct
  misc_feature 1..1302: note = derived and/or modified CDS sequence (wt) from PUUV(Udmurtia/338Cg/92)__Z30708.1__N
  source 1..1302: mol_type = other RNA
atgagtgacttgacagacatccaagaggagataacccgccatgagcaacaacttgttgttgccagacaaaaactcaaggatgcagagagagcagtggaagtggacccggatgacgttaacaaaaacacactacaagcaaggcaacaaacagtgtcagcattggaggataaactcgcagactataagagaagaatggcagattctgtgtcccggaaaaaaatggatactaaacctactgatccgactgggattgaacctgatgatcatctcaaggagagatcaagccctagatatggaaatgtccttgatgtaaatgccattgacatcgaagaaccaagtggtcagacagcagattggtatactattggagtctatgtaataggttttacaattcccatcattttaaaggctctatacatgttgtcaacacgtggaagacagaccataaaagaaaataagggaacacggatcaggttcaaagatgacacatcgtttgaggatattaatggcattaggagaccaaaacatctatatgtatccatgcctactgcccagtccaccatgaaagctgaagaacttacacccggacggttccgtacaatagtatgtggcttatttcctacacagatacaagtgcgtaacatcatgagtccagtaatgggagtgattggtttttctttctttgtcaaagactggccagagaggattagggattttatggaaaaggaatgccccttcataaagccagaagttaaacccgggacaccagcacaggagatagaatttttgaaaagaaatagggtttatttcatgactcgccaagatgttcttgataaaaatcatgtggctgacattgataagttaattgactatgcagcctctggagaccctacatcacctgatgacattgaatcccctaatgcaccgtgggtatttgcctgtgcaccagatcggtgcccccctacatgcatttatgttgctgggatggctgaattgggtgcattcttttcgatcctacaggatatgaggaacactattatggcatctaaaactgtaggtacagcagaagaaaaattaaaaaagaagtcctccttctatcaatcatacctacgccggacacaatcaatggggattcaacttgatcagaggataatcctactgtacatgttggagtgggggaaagaaatggtggatcatttccatcttggtgatgatatggatcctgagctaagaggccttgctcagtcactcatagaccagaaggtaaaagagatatcaaatcaggagcccttaaagatatga

SEQ ID NO: 2817 - RNA, 1302 nt, synthetic construct
  misc_feature 1..1302: note = derived and/or modified CDS sequence (wt) from PUUV(Udmurtia/444Cg/88)__Z30706.1__N
  source 1..1302: mol_type = other RNA
atgagtgacttgacagacatccaagaggagataacccgccatgagcaacaacttgttgttgccagacaaaaactcaaggatgcagagagagcagtggaagtggacccggatgacgttaataaaaacacactacaagcaaggcaacaaacagtgtcagcattggaggataaactcgcagactacaagagaagaatggcagatgctgtgtcccggaaaaaaatggatactaaacctactgacccgactgggattgaacctgatgatcatctcaaggagagatcaagccttagatatggaaatgtccttgatgtgaatgccattgacatcgaagaaccaagtggtcagacagcagattggtatactattggagtctatgtgataggttttacaattcccatcattttaaaggctttatacatgttgtcaacacgtggaagacagaccgtaaaagaaaataaaggaacacggatcaggttcaaagatgacacatcgtttgaggatattaatggcatcaggagaccaaaacatctatatgtatccatgcctactgcccagtccaccatgaaagctgaagaacttacacccggacggttccgtacaatagtatgtggcttatttcctacacagatacaagtgcgtaacatcatgagtccagtaatgggagtgattggtttttctttctttgtcaaagactggccagagaggattagggattttatggaaaaggaatgccccttcataaagccagaagttaaacccgggacaccagcacaggagatagaatttttaaaaagaaacagggtttatttcatgactcgccaagatgttcttgataaaaatcatgtggctgacattgataagttaattgactatgcagcctctggtgaccctacatcacctgatgacattgaatcccctaatgcaccgtgggtatttgcctgtgcaccagatcggtgtccccctacatgcatttatgttgctgggatggctgaattgggtgcattcttttcgatcctacaggatatgaggaacactattatggcatctaaaaccgtaggtacagcagaagaaaaattaaaaaagaagtcctccttctatcaatcatacctacgccggacacaatcaatggggattcaacttgatcagaggataatcctactgtacatgttggagtgggggaaagaaatggtggatcatttccatcttggtgatgatatggatcctgagctaagaggccttgctcagtcactcatagaccagaaggtaaaagagatatcaaatcaggagcccttaaagatatga

SEQ ID NO: 2818 - RNA, 1302 nt, synthetic construct
  misc_feature 1..1302: note = derived and/or modified CDS sequence (wt) from PUUV(Udmurtia/894Cg/91)__Z21497.1__N
  source 1..1302: mol_type = other RNA
atgagtgacttgacagacatccaagaggagataacccgccatgagcaacaacttgttgttgccagacaaaaactcaaggatgcagagagagcagtggaagtggacccggatgacgttaacaaaaacacactacaagcaaggcaacaaacagtgtcagcattggaggataaactcgcagactacaagagaagaatggcagatgctgtgtcccggaaaaaaatggatactaagcctactgacccgactgggatcgaacctgatgatcatctcaaggagagatcaagccttagatatggaaatgtccttgatgtaaatgccattgacatcgaagaaccaagtggtcagacagcagattggtatactattggagtctatgtaataggttttacaattcctatcattttgaaggctctatatatgttgtcaacacgtggaagacagaccgtaaaagaaaataaaggaacacggatcaggttcaaagatgacacatcatttgaggatattaatggcatcaggagaccaaaacatctatatgtatccatgcctactgcccagtccaccatgaaagctgaagaacttacacctggacgatttcgtacaatagtatgtggcttatttcctacacagatacaagtgcgtaacatcatgagtccagtaatgggagtgattggtttttctttctttgtcaaagactggccagagaggattagggattttatggaaaaggaatgccccttcataaagccagaagttaaacccgggacaccagcacaggagatagaatttttgaaaagaaacagggtttatttcatgactcgccaagatgttcttgataaaaatcatgtggctgacattgataagttaattgactatgctgcctctggtgaccctacatcacctgatgacattgaatcccctaatgcaccgtgggtatttgcctgtgcaccagatcggtgcccccctacatgcatttatgttgttgggatggctgaattgggtgcattcttttcgatcctacaggatatgaggaacactattatggcatctaaaactgtaggtacagcagaagaaaaattaaaaaagaagtcctccttctatcaatcatacctacgtcggacacaatcaatggggattcaacttgatcagaggataattctactatacatgttggagtgggggaaagaaatggtggatcatttccatcttggtgatgatatggatcctgagctaagaggccttgctcagtcactcatagaccagaaggtaaaagagatatcaaaccaagagcccttaaagatatga

SEQ ID NO: 2819 - RNA, 1302 nt, synthetic construct
  misc_feature 1..1302: note = derived and/or modified CDS sequence (wt) from PUUV(Fusong-Cr-247)__EF442087.1__N
  source 1..1302: mol_type = other RNA
atgagtgacttaaaagatatacaggaggacatagcccgccatgagcaacaacttgttgttgccagacaaaagctcagggatgcagaaaaggcagtggagatggacccagatgacgttaacaataacacactgcaagcaaggcaacaaacagtgtcagcattggaggataaaattgcagacttcaagagaagaatggcagacattgtgtcccggaaaaagatggatactaagcctgctgacccgactgggattgagcctgatgaccacctcaaggagagatcaagtcttcgatatggaaatgtccttgatgtgaatgccatcgacattgaggaaccaagtggtcagacagcagactggtatactattggggtatacataattggatttacactgcctataatactcaaagccctgtacatgctgtcaacgaggggaaggcagactgtcaaagagaataaagggacacggatccgtttcaaggatgacacttcttttgaggatgtgaatgggatcagacgaccgaaacatctctatgtgtcaatgccaaccgcacagtctaccatgaaggcagaagaactgacaccagggaggttcagaacaattgtttgcggcctatttcctacacagattcaagtgagaaataccatgagccccgtaatgggagtgatcggattctccttctttgcaaaggactggccagataggatcaaagaatttatggagaaagaatgtccctttataaaacctgaagtcaagcctggaacaccagcaaaggaagttgaaatattaaagaggaataagatctatttcatgcagaggcaggatgtgcttgacaagaatcatgtcccagatattgataaactaattgattatgcagcttcaggtgatccgacatccccagagaacattgactcaccaaatgcaccatgggtgtttgcatgtgccccagatagatgccccccaacttgtatttatgttgcagggatggcagagctaggtgcctttttttcaatcttgcaggatatgagaaataccatcatggcatcaaagactgtaggaacagctgaagagaagttaaagaaaaaatcatcattttaccaatcttatctgcggcgcacacagtcaatgggaatacagcttgatcaacggataatactgttgtatatgttggaatggggaaaggaaatggttgatcatttccatttgggagatgatatggaccctgagctgaggagtctggcgcaggcattgattgatcagaaggttaaggagatctccaaccaggagcccttaaagatatga

SEQ ID NO: 2820 - RNA, 1302 nt, synthetic construct
  misc_feature 1..1302: note = derived and/or modified CDS sequence (wt) from MUV(11-4)__JX046484.1__N
  source 1..1302: mol_type = other RNA
atgagtgacttaaaggaaatacaagaagatatagcccgccatgaacaacaacttgtggttgcaaggcaaaagctcagggatgcagaaaaggcagtggaagtggaccccgatgacgttaacaagaacacactgcaggcacggcaacagacagtgtcagcattggaggataaacttgcagacttcaagagacaaatggcagactttgtgtcccggaaaaagatggatactaagcctactgatccgactgggattgagcctgacgatcacctcaaggaaagatcaagcctcaggtatgggaatgtccttgatgtgaatgcaatagacatagaagaaccaagtggccaaacagcagactggtatacaattggggtatacatcattgggttcacattaccgattgtcctgaaagcactgtacatgctatctacaaggggtaggcaaacagttaaagaaaacaaagggacaaggattagatttaaggatgacacttcctttgaagacattaatggaattcgcaggcccaaacatctatatgtgtcaatgccaactgctcaatccactatgaaggcagaggagttaacaccgggtaggttcaggacaattgtatgtggactatttcctacacaaattcaagttagaaatataatgagtccggtgatgggagtgattggcttttctttctttgtaaaagattgggctgacagaattaaagagttcatggagaaagaatgtccgttcataaagccagagccgaaaccgggtacacctgctagtgaagttgagtttttaaagcgaaataagatctatttcatgagcagacaagatgtcttggataaaaatcatgttcctgacattgataagctgattgactatgctgcctcaggagacccaacatcacctgacaacattgaagatccaaatgcaccatgggtattttcgtgtgctcctgatagatgcccacctacatgcctttatgtggccgggatggcagaacttggtgcattcttttcaatcctccaagatatgcggaatacaatcatggcatcaaaaacagtgggcacggctgaggagaaacttaagaaaaaatcgtcattttatcagtcatatttgaggcggacacaatcaatgggaatacaactggaccaacggattattctactttacatgcttgaatggggaaaggaaatggtagaccacttccacctgggtgatgacatggatcctgagctgcggaccttggcacaggctttgatcgaccagaaggtaaaggaaatatctaaccaagaaccccttaaaatttaa

SEQ ID NO: 2821 - RNA, 1302 nt, synthetic construct
  misc_feature 1..1302: note = derived and/or modified CDS sequence (wt) from MUV(00-18)__DQ138128.1__N
  source 1..1302: mol_type = other RNA
atgagtgacttaaaggaaatacaagaagacatagcccgccatgaacagcaacttgtggtggcaaggcaaaaactcagggatgcagagaaggcagtggaggtggacccagatgacgttaacaagaacacactgcaggcacggcaacaaacagtgtcagcattggaggataaacttgcagacttcaagagacaaatggcagactttgtgtccaggaaaaagatggatactaagcctactgacccgactgggattgagcctgatgaccacctcaaagagagatcaagtctcagatatgggaatgtccttgatgtgaatgcaatagatatagaagaaccaagtggtcaaacagcagattggtatacaattggtgtgtatgtcattgggtttacactgccaattgtcctgaaagcattgtatatgttgtccacaaggggaaggcaaacagtcaaagagaataagggaacacgaattaggtttaaggatgacacctcatttgaagacatcaatggtattcgaagacctaaacacctatatgtttcaatgccaactgctcaatccactatgaaggctgaggaactgacaccaggtaggttccggacaattgtgtgtggtttgttcccaacacagatccaggtgagaaacatcatgagtcctgtaatgggagtaatagggttttccttctttgttaaagattgggttgaaagaatcaaagagttcatggagaaagaatgcccgtttattaagccagaacctaaaccaggcacaccagctagtgaagttgagttcttgaaacgaaacaagatctatttcatgaataggcaagatgtcttagataagaatcatgttcctgacattgataaattgattgattatgcagcctcaggagatccaacatcacctgacaatatagaggatcctaatgcaccatgggtattctcctgtgctccagataggtgtccacctacatgtctctatgttgctggaatggccgaattaggtgcattcttctcaatccttcaggacatgaggaatacaataatggcatccaaaactgtaggcactgctgaagaaaagctgaagaagaaatcgtcattttatcaatcatacctcaggcggacacagtcaatgggaatccaactggatcagaggattattctactctatatgcttgagtggggaaaagagatggtagatcactttcacctgggggatgatatggatcctgagctgagaaccttagcacaggcattgattgaccaaaaggtgaaagagatatccaatcaggaaccccttaaaatttag

SEQ ID NO: 2822 - RNA, 1302 nt, synthetic construct
  misc_feature 1..1302: note = derived and/or modified CDS sequence (wt) from MUV(11-1)__JX028273.1__N
  source 1..1302: mol_type = other RNA
atgagtgacttaaaggaaatacaagaagatatagcccgccatgaacaacaacttgtggttgcaaggcaaaagctcagggatgcagaaaaggcagtggaagtggaccccgatgacgttaacaagaacacactgcaggcacggcaacagacagtgtcagcattggaggataaacttgcagacttcaagagacaaatggcagactttgtgtcccggaaaaagatggatactaagcctactgatccgactgggattgagcctgacgatcacctcaaggaaagatcaagcctcaggtatgggaatgtccttgatgtgaatgcaatagacatagaagaaccaagtggccaaacagcagactggtatacaattggggtatacatcattgggtttacattaccgattgtcctgaaagcactatacatgctatctacaaggggtaggcaaacagttaaagaaaacaaagggacaaggattagatttaaggatgacacttcctttgaagacattaatgggattcgcaggcccaaacatctatacgtgtcaatgccaactgctcaatccactatgaaggcagaagagttaacaccgggcaggttcaggacaattgtatgtggactatttcctacacaaattcaagttagaaatataatgagtccagtgatgggagtgattggcttttctttttttgtaaaagattgggctgacagaattaaagagttcatggagaaagaatgtccgttcataaagccagagccaaaaccgggtacacctgctagtgaaattgagtttttaaagcgaaataagatctatttcatgagcagacaagatgtcctggataaaaatcatgttcctgacattgataagctgattgactatgctgcctcaggagacccaacatcacctgacaacattgaagatccaaatgcaccatgggtattctcgtgtgctcctgatagatgcccacctacatgtctttatgtggcagggatggcagagcttggtgcattcttttcaatcctccaagatatgcggaatacaatcatggcatcaaaaacagtgggcacagctgaggagaaacttaagaaaaaatcgtcattctatcagtcatatttgaggcggacacaatcaatgggaatacaactggaccaacggattattttactttacatgcttgaatggggaaaggaaatggtagaccacttccacttgggtgatgacatggatcctgagctacggaccttggcacaggctttgatcgaccagaaagtgaaggaaatatctaaccaagaaccccttaaaatttaa

SEQ ID NO: 2823 - RNA, 1302 nt, synthetic construct
  misc_feature 1..1302: note = derived and/or modified CDS sequence (wt) from MUV(96-1)__DQ138133.1__N
  source 1..1302: mol_type = other RNA
atgagtgacttaaaggaaatacaagaagacatagcccgccatgaacagcaacttgtggtggcaaggcaaaaactcagggatgcagagaaggcagtggaggtggacccagatgacgttaacaagaacacactgcaggcacggcaacaaacagtgtcagcattggaggataaacttgcagacttcaagagacaaatggcagactttgtgtccaggaaaaagatggatactaagcctactgacccgactgggattgaacctgatgaccacctcaaagagagatcaagtctcagatatgggaatgtccttgatgtgaatgcaatagatatagaagaaccaagtggtcaaacagcagattggtatacaattggtgtgtatgtcatcgggtttacactgccaattgtcctgaaagcattgtatatgttgtccacaaggggaaggcaaacagtcaaagagaataagggaacacgaattaggtttaaggatgacacctcatttgaagacatcaatggtattcggagacctaaacacctatatgtttcaatgccaactgctcaatccactatgaaggctgaggaactaacaccaggtaggttccggacaattgtgtgtggtttgttcccaacacagatccaggtgagaaacatcatgagtcctgtaatgggagtaataaggttttccttcttggttaaagattggtctgaaaaaatcaaagagttcatggagaaagaatgcccatttattaagccagaacctaaaccaggcacaccagctagtgaaattgagttcttgaaaagaaacaagatctatttcatgaataggcaagatgtcttagataagaatcatgtacctgatattgataaactgattgattatgcagcctcaggagatccaacatcacctgacaatatagaggctcctaatgcaccatgggtattctcctgtgctccagataggtgtccgcctacatgtctctatgttgcagggatggccgaattaggtgcattcttctcaatccttcaggacatgaggaatacaataatggcatctaaaactgtaggcactgctgaagaaaagctgaagaagaaatcgtcattttatcaatcatacctcaggcggacacagtcaatgggaatccaactggatcagaggattattctactctatatgcttgagtggggaaaagagatggtagatcactttcacctgggggatgatatggatcctgagctgagaaccttagcacaggcattgattgaccaaaaggtgaaagagatatccaatcaggaaccccttaaaatttag

SEQ ID NO: 2824 - RNA, 1302 nt, synthetic construct
  misc_feature 1..1302: note = derived and/or modified CDS sequence (wt) from MUV(99-28)__DQ138142.1__N
  source 1..1302: mol_type = other RNA
atgagtgacttaaaggaaatacaagaagacatagcccgccatgaacagcaacttgtggtggcaaggcaaaaactcagggatgcagagaaggcagtggaggtggacccagatgacgttaacaagaacacactgcaggcacggcaacaaacagtgtcagcattggaggataaacttgcagacttcaagagacaaatggcagactttgtgtccaggaaaaagatggatactaagcctactgacccgactgggattgagcctgatgaccacctcaaagagagatcaagtctcagatatgggaatgtccttgatgtgaatgcaatagatatagaagaaccaagtggtcagacagcagattggtatacaattggtgtgtatgtcattgggtttacactgccaattgtcctgaaagcattgtatatgttgtccacaaggggaaggcaaacagtcaaagagaataagggaacacgaattaggtttaaggatgacacctcatttgaagacatcaatggtattcgaagccctaaacacctatatgtttcaatgccaactgctcaatccactatgaaggctgaggaactgacaccaggtaggttccgtacaattgtgtgtggtttgttcccaacacagatccaggtgagaaacatcatgagtcctgtaatgggagtgatagggttttccttctttgttaaagattgggttgaaagaatcaaagagttcatggagaaagaatgcccatttattaagccagaacctaaaccaggcacaccagctagtgaagttgagttcttgaaacgaaacaagatctatttcatgaataggcaagatgtcttagataagaatcatgttcctgacattgataaactgattgattatgcagcctcaggagatccaacatcacctgacaatatagaggatcctaatgcaccatgggtattctcctgtgctccagataggtgtccacctacatgtctctatgttgctggaatggccgaattaggtgcattcttctcaatccttcaggacatgaggaatacaataatggcatccaaaactgtaggcactgctgaagaaaagctgaagaagaaatcgtcattttaccaatcatacctcaggcggacacagtcaatgggaatccaactggatcagaggattattctactctatatgcttgagtggggaaaagagatggtagatcactttcacctgggggatgatatggatcctgagctgagaaccttagcacaggcattgattgaccaaaaggtgaaagagatatccaatcaggaaccccttaaaatttag

SEQ ID NO: 2825 - RNA, 1290 nt, synthetic construct
  misc_feature 1..1290: note = derived and/or modified CDS sequence (wt) from SANGV(SA14)__NC_034526.1__N
  source 1..1290: mol_type = other RNA
atggcaacactagaggagatccaaaaggaaatcaacatccatgagggtcaactaattatagcaaagcaaaaggtgaaggatgctgaaaaacagtatgagaaggatcctgatgaccttaataagagggcactcagtgatagagaaggaattgctcattccatccagagcaaaatagatgagttgcggagacaacttgctgatagggttgcagcaggacggaacctggggcaagaacgagatccaaccggtgttgaaccaggagatcatctcagagaaaaatccatgctcagttatggaaatgttatcgacttgaaccatctagatattgatgaaccaactgggcagactgcagactggctgagtattgtgatttacttgacttcatttgtggtgccaattttgttgaaggcactttatatgcttacaacaagagggaggcaaactactaaggataacaagggaatgaggattaggtttaaggacgacagctcttttgaagatgtcaatgggattagaaagcctaagcatctgtttttatcgatgccaaatgcacaatctagtatgaaggctgaagaaattactccaggaagattccgcactgcagtttgtggattgtatccagcacagataaaagcaagaaatatggtcagcccagtgatgagtgttattggctttattactctagccagagactggactgaaagaattgaaaattggcttgaccaaccttgcaaatttatgtctgaaccatctcagacttcattgcagaagggccctgcaacaaatagagactatctaaaccaaaggcaggcctcccttgcacaaatggaaacaaaagaagctcaggctgtcagacaacaagcagttgatgctggttgtaatttagtggaccacattgactcaccatcatcaatttgggtatttgcaggagcacctgatcgctgtccaccaacctgcctgttcatatcaggtatggctgaactaggagctttcttttcaatactgcaggatatgagaaatacaattatggcatcaaaaactgtcgggacatctgaggaaaagcttaggaagaaatcgtcattctaccagtcttaccttagaagaacgcaatctatgggaatacaacttgatcagaggataattatcatgttcatggtggaatggggtaaagaggctgttgatggatttcatcttggtgatgatatggatcctgaactgcgatcatttgctcaggcattgattgatcagaaagtgaaagagatatctaatcaggaaccacttaagatttag

SEQ ID NO: 2826 - RNA, 1290 nt, synthetic construct
  misc_feature 1..1290: note = derived and/or modified CDS sequence (wt) from SANGV(SA22)__JQ082303.1__N
  source 1..1290: mol_type = other RNA
atggcaacactagaggagatccaaaaggaaatcaacatccatgagggtcaactaattatagcaaagcaaaaggtgaaggatgctgaaaaacagtatgagaaagatcctgatgacctcaataagagggcactcagtgatagagaaggaattgctcattccatccagagcaaaatagatgagttgcggaggcaacttgctgatagggttgcagcaggacggaacctggggcaagaaagagatccaaccggtgttgaaccaggagatcatctcagagaaaaatccatgctcagttatggaaatgtgatagacttgaaccatctagatattgatgaaccaactgggcagactgcagactggctgagcattgtgatttacttgacttcatttgtggtgccaattttgttgaaggcactttatatgcttacaacaagagggaggcaaactactaaggataacaagggaatgaggattaggtttaaggacgacagctcttttgaagatgtcaatgggatcagaaagcctaagcatctgtttttgtcgatgccaaatgcacaatctagtatgaaggctgaagaaattactccgggaagattccgcactgcagtttgtggattgtatccagcacagataaaagcaagaaatatggtcagcccagtgatgagtgttattggctttatcactctagccagagactggactgagagaattgaaaattggcttgaccaaccttgcaaatttatgtctgaaccatctcagacttcattgcagaagggccctgcaacaaacagagactatctgaaccaaagacaggcctcccttgcacaaatggagacaaaagaagctcaggctgtcagacaacaggcagttgatgctggttgtaatttagtggaccacattgactcaccatcatcaatttgggtatttgcaggagcacctgatcgctgtccaccaacctgtctgttcatatcaggcatggctgaactaggagctttcttttcaatactgcaggatatgagaaatacaattatggcatcaaaaactgtcgggacgtctgaggaaaagcttaggaagaaatcatcattctaccagtcttatctcagaagaacgcaatctatgggaatacaacttgatcagaggattatcattatgttcatggtggaatggggtaaagaggttgttgatggatttcatcttggtgatgatatggatcctgaactgcgatcatttgctcaggcattgattgatcagaaagtgaaagagatatctaatcaggaaccacttaagatttag

SEQ ID NO: 2827 - RNA, 1290 nt, synthetic construct
  misc_feature 1..1290: note = derived and/or modified CDS sequence (wt) from SEOV(L99)__AF288299.1__N
  source 1..1290: mol_type = other RNA
atggcaactatggaagaaatccagagagaaatcagtgcccacgaggggcagcttgtgatagcacgccagaaagtcaaggatgcagaaaagcagtatgaaaaggatcctgatgacttaaacaagaggacactgcatgatcgggagagtgtcgcagcttcaatacaatcaaaaattgatgaattgaagcgccaacttgccgacaggattgcagcagggaagaatattgggcaagaccgggatcctacaggggtagagccgggtgatcatctcaaagagagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcagacttcaaaggacaacaaagggatgaggatcagattcaaggatgacagctcatatgaggatgtcaatggaatcagaaaacccaaacatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtagttgggtttttggcactggcaaaagattggacatctagaattgaagaatggcttggtgcaccctgcaagtttatggcggaatctccaattgctgggagtttatctgggaatcccgtgaatcgtgactatatcagacagagacaaggtgcacttgcagggatggagccaaaggaatttcaagccctcaggcaacatgcaaaggatgctgggtgtacactggttgagcatattgagtcaccatcatcaatatgggtgtttgctggggcccctgataggtgtccaccaacatgtttgtttgtcggagggatggctgagttaggtgccttcttttctatacttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtgtacaactttcatctcggtgatgacatggacccagagcttcgtagcctggctcagatcctgattgaccagaaagtaaaagaaatctcgaaccaggaacctatgaaattataa

SEQ ID NO: 2828 - RNA, 1290 nt, synthetic construct
  misc_feature 1..1290: note = derived and/or modified CDS sequence (wt) from SEOV(SG42/2011)__KY807171.1__N
  source 1..1290: mol_type = other RNA
atggcaactatggaagaaatccaaagagaaattagtgcacacgaggggcagcttgtgatagcacgtcagaaggtcaaggatgctgaaaagcagtatgagaaggatcctgatgatttgaacaagagggcactgcatgatcgggagagtgtggcagcttcaatacaatcaaaaattgatgaattaaagcgccaacttgctgataggattgcagcaggtaagaatatcgggcaagatcgggatcccacaggggtagagccgggtgaccaccttaaagagagatcagcattaagctatgggaacacactggatttgaacagtcttgacattgacgaaccaacaggacagactgctgattggtcgactataattgtctacttgacatcgtttgttgtcccaatcatcttgaaggcactttatatgctaacaacgagaggccggcaaacttcaaaagataacaagggaatgaggatcaggttcaaagatgacagctcatatgaagatgtcaacggaatccggaagccaaagcacctgtatgtgtcaatgcctaatgcccaatccagcatgaaggctgaagagatcacacctgggcgattccgtactgctgtatgtgggctctatcctgcacagataaaggcaagaaatatggtaagccctgtcatgagtgtggttgggttcttggcactggcaaaggattggtcatctaggattgaagaatggcttggggcaccatgtaagtttatggctgagtctcccattgccgggagtctatctggaaatccggttaaccgtgattacatccgacagagacaaggtgcacttgcagggatggagcctaaagaatttcaagcccttaggcaacactcaaaggatgctggctgtacactggtggaacatattgagtcaccatcatcgatatgggtgtttgctggggctcctgataggtgtccaccaacatgtttgtttgttggaggaatggcagagctgggtgctttcttctccatactccaagacatgagaaacacaatcatggcttccaagactgtgggaactgcagatgagaagttgaggaagaaatcatcattttaccaatcttaccttcgacgcacacaatcaatgggaattcaactggatcagagaataattgttatgtttatggttgcctggggcaaggaagcagtagataactttcatcttggtgatgatatggatccagagctccgtagccttgctcagatcctgattgatcaaaaggtgaaggaaatctcaaaccaggagcctatgaaattataa

SEQ ID NO: 2829 - RNA, 1290 nt, synthetic construct
  misc_feature 1..1290: note = derived and/or modified CDS sequence (wt) from SEOV(XJ2/2011)__KY807169.1__N
  source 1..1290: mol_type = other RNA
atggcaactatggaagaaatccagagagaaatcagtgctcacgaggggcagcttgtgatagcacgccagaaggtcaaggatgcagagaaacagtatgagaaggatcctgacgatttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggcgatcatctcaaggaaagatcagcattaagctatgggaatacactggacctgaatagtcttgacattgatgaacctacaggacagacagctgattggttgaccataattgtctatctgacatcattcgtggtcccgatcatcttgaaggcactgtatatgttaacaacaagaagtaggcagacttcaaaggacaacaaggggatgaggatcaggttcaaggatgacagctcatatgaggatgtcaatgggattagaaagcctaaacatctgtatgtgtcaatgccaaacgcccaatctagcatgagggctgaagagataacacctggaagattccgtactgcagtatgtgggctatatcctgcacagataaaggcaaggaacatggtaagtcctgtcatgagtgtagttgggtttttggcactggcaaaagactggacatctagaattgaagaatggcttggcgcaccctgcaagttcatggcagagtctcccattgccgggagtttatctgggaatcctgtaaaccgtgactatatcagacagagacaaggtgcacttgcaggatgggagccaaaggaatttcaagccctcaggcaacattcaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatcttggtgatgacatggatccagagctacgtagcctggctcagatcttgattgaccagaaagtgaaggaaatttcaaaccaggaacctatgaaattataa

SEQ ID NO: 2830 - RNA, 1290 nt, synthetic construct
  misc_feature 1..1290: note = derived and/or modified CDS sequence (wt) from SEOV(XJ5/2011)__KY807170.1__N
  source 1..1290: mol_type = other RNA
atggcaactatggaagaaatccagagagaaatcagtgctcacgaggggcagcttgtgatagcacgccagaaggtcaaggatgcagagaaacagtatgagaaggatcctgacgatttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggcgatcatctcaaggaaagatcagcattaagctatgggaatacactggacctgaatagtcttgacattgatgaacctacaggacagacagctgattggttgaccataattgtctatctgacatcattcgtggtcccgatcatcttgaaggcactgtatatgttaacaacaagaggtaggcagacttcaaaggacaacaaggggatgaggatcaggttcaaggatgacagctcatatgaggatgtcaatgggattagaaagcctaaacatctgtatgtgtcaatgccaaacgcccaatctagcatgaaggctgaagagataacacctggaagattccgtactgcagtatgtgggctatatcctgcacagataaaggcaaggaacatggtaagtcctgtcatgagtgtagttgggtttttggcactggcaaaagactggacatctagaattgaagaatggcttggcgcaccctgcaagttcatggcagagtctcccattgccgggagtttatctgggaatcctgtaaaccgtgactatatcagacagagacaaggtgcacttgcagggatggagccaaaggaatttcaagccctcaggcaacatccaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggatatgaggaacacaatcatggcttcaaaaactgtgagcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatcttggtgatgacatggatccagagctacgtagcctggctcagatcttgattgaccagaaagtgaaggaaatttcaaaccaggaacctatgaaattataa

SEQ ID NO: 2831 - RNA, 1290 nt, synthetic construct
  misc_feature 1..1290: note = derived and/or modified CDS sequence (wt) from SEOV(10-134)__JF693882.2__N
  source 1..1290: mol_type = other RNA
atggcaactatggaggaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaactgaagcgccaacttgccgacaggattgcagcagggaagaacatcgggcaagaccgggatcctacaggggtagagccgggtgatcatctcaaggaaagatcagcactaagctacgggaatacactggacctgaatagtcttgacattgatgaacctacaggacagacagctgattggctgaccataattgtctatctaacatcattcgtgctcccgatcatcttgaaggcactgtacatgttaacaacaagaggtaggcagacttcaaaggacaacaaggggatgaggatcagattcaaggatgacagctcatatgaggatgtcaatgggatcagaaagcctaaacatctgtatgtgtcaatgccaaacgcccaatccagcatgaaggctgaagagataacaccaggaagattccgcactgcagtatgtgggctataccctgcacagataaaggcaaggaatatggtaagccctgtcatgagtgtagttgggtttttggcactggcaaaagactggacatctagaattgaagaatggcttggcgcaccctgcaagttcatggcagagtctcctattgctgggagtttatctgggaatcctgtgaatcgtgactatatcagacagagacaaggtgcacttgcagggatggagccgaaggaatttcaagccctcaggcaacattcaaaggatgctggatgtacactagttgagcatattgagtcaccatcatcaatatgggtgtttgctggggcccctgataggtgtccaccaacatgcttgtttgtcggagggatggctgagttaggtgccttcttttctatacttcaggatatgaggaacacaatcatggcttcaaaaactgtgggcacagctgatgaaaagcttcgaaagaaatcatcattctatcaatcatacctcaggcgcacacaatcaatgggaatacaactggaccagaggataattgttatgtttatggttgcctggggaaaggaggcagtggacaactttcatctcggtgatgacatggatccagagcttcgtagcctagctcagatcctgattgaccagaaagtgaaggaaatctcgaaccaggaacctatgaaattataa

SEQ ID NO: 2832 - RNA, 1290 nt, synthetic construct
  misc_feature 1..1290: note = derived and/or modified CDS sequence (wt) from SEOV(DPRK08)__JX853575.1__N
  source 1..1290: mol_type = other RNA
atggcaactatggaggaaatccagagagagatcagtgctcacgaggggcagcttgtgatagcacgccagaaggtcaaggatgcagaaaagcagtatgagaaggatcctgatgacctaaacaagagggcactgcatgatcgggagagtgtcgcagcttcgatacaatcaaaaatcgatgaattgaagcgccagcttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaacgcccaatccagcatgaaagctgaagagataacacctggaaggttccgcacggcagtatgtgggctgtatcctgcacagataaaggcaaggaacatggtaagccctgtcatgagtgtagttggttttttggcactggcaaaagactggacatcaagaattgaagaatggcttggcgcaccctgcaagttcatggcagagtctcccattgccgggagcttatctgggaatcctgtgaatcgtgactatatcagacaaagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtcccccaacatgcttgtttgtcggagggatggccgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggatccagaacttcgtagcctggctcagatcctgattgaccagaaagtgaaggagatctcaaaccaggaacctatgaaattgtaa

SEQ ID NO: 2833 - RNA, 1290 nt, synthetic construct
  misc_feature 1..1290: note = derived and/or modified CDS sequence (wt) from SEOV(Fj372/2013)__KP645198.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgtcaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataatcgtctatctgacatcatttgtggtcccgatcatcttaaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaatgcccaatccagcatgaaagctgaagagataacacctggaagattccgaacggcagtatgtgggctatatcctgcacagataaaggcaaggaacatggtaagccctgtcatgagtgtagttgggtttttggcactggcaaaagactggacatctagaattgaagaatggcttggcgcaccctgcaagttcatggcggagtctcccattgccgggagcctatctggaagtcctgtgaatcgtgactatatcagacagagacaaggtgcacttgcaggaatggagccaaaggaatttcaagccctcaggcaacatgcaaaggatgctggatgtacactggttgaacatattgagtcaccatcatcaatatgggtgtttgctggggcccctgataggtgtccaccaacatgcttgtttgtcggagggatggctgagttaggtgccttcttttctatccttcaggatatgaggaacacaatcatggcttcaaaaactgtgggcacggctgatgaaaagctccgaaagaaatcatcattctatcaatcatacctcagacgcacacaatcaatgggaatacaactggaccagaggataattgttatgtttatggttgcctggggaaaggaggcagtggacaactttcatctcggtgatgacatggatccagagcttcgtagcctggctcagatcctgattgaccagaaagtgaaggaaatctcaaaccaggaacctatgaaattataa

SEQ ID NO: 2834 - RNA, 1290 nt, synthetic construct
  misc_feature 1..1290: note = derived and/or modified CDS sequence (wt) from SEOV(HeB38)__JN377553.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccaggtgatcatctcaaggaaaggtcagcactgagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaataaggggatgaagatcagattcaaggatgacagctcatatgaggatgtcaatggaatcagaaagcccaaacatctgtatgtgtcaatgccaaacgcccaatccagcatgaaagctgaagagataacacctggaagattccgcacggcagtctgtgggctatatcctgcacagataaaggcaaggaacatggtaagccctgtcatgagtgtagttgggtttttggcactggcaaaagactggacatctagaattgaagaatggcttggtgcaccctgcaagtttatggcggaatctcccattgccgggagtttatctgggaatcctgtgaatcgtgactatatcagacagagacaaggtgcacttgcaggaatggagccaaaggaatttcaagccctcaggcaacattcaaaggatgctggatgtacactggttgaacatattgagtcaccatcgtcaatatgggtgtttgctggggcccctgataggtgtccaccaacatgcctgtttgtcggagggatggctgaattaggtgccttcttttctatccttcaggatatgaggaacacaatcatggcttcaaaaactgtgggcacagctgatgaaaagcttcgaaagaaatcaccattctatcaatcatacctcagacgcacacaatcaatgggaatacaactggaccagagaataattgttatgtttatggttgcctggggaaaggaggcagtggacaactttcatctcggtgatgacatggatccagagctccgtggcctggctcagatcctgattgaccagaaagtgaaggaaatctcaaaccaggaacctatgaaattataa

SEQ ID NO: 2835 - RNA, 1290 nt, synthetic construct
  misc_feature 1..1290: note = derived and/or modified CDS sequence (wt) from SEOV(JiangxiXinjianRn-07-2011)__KP859511.1__N
  source 1..1290: mol_type = other RNA
atggcaactatggaagaaatccagagagaaatcagtgctcacgaggggcagcttgtgatagcacgccagaaggtcaaggatgcagagaaacagtatgagaaggatcctgacgatttaaacaagagggcactgcatgatcgggagagtgtcgcagcttcaatacaatcaaaaattgatgaattgaagcgccaacttgccgacaggattgcagcagggaagaacatcgggcaagaccgggatcccacaggggtagagccgggcgatcatctcaaggaaagatcagcattaagctatgggaatacactggacctgaatagtcttgacattgatgaacctacaggacagacagctgattggttgaccataattgtctatctgacatcattcgtggtcccgatcatcttgaaggcactatatatgttaacaacaagaggtaggcagacttcaaaggacaacaaggggatgaggatcaggttcaaggatgacagctcatatgaggatgtcaatgggattagaaagcctaaacatctgtatgtgtcaatgccaaacgcccaatctagcatgaaggctgaagagataacacctggaagattccgcactgcagtatgtgggctatatcctgcacagataaaggcaaggaacatggtaagtcctgtcatgagtgtagttgggtttttggcactggcaaaagactggacatctagaattgaagaatggcttggcgcaccctgcaagttcatggcagagtctcccattgccgggagtttatctgggaatcctgtaaaccgtgactatatcagacagagacaaggtgcacttgcagggatggagccaaaggaatttcaagccctcaggcaacattcaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatcttggtgatgacatggatccagagctacgtagcctggctcagatcttgattgaccagaaagtgaaggaaatttcaaaccaggaacctatgaaattataa

SEQ ID NO: 2836 - RNA, 1290 nt, synthetic construct
  misc_feature 1..1290: note = derived and/or modified CDS sequence (wt) from SEOV(JiangxiXinjianRn-09-2011)__KP859512.1__N
  source 1..1290: mol_type = other RNA
atggcaactatggaagaaatccagagagaaatcagtgctcacgaggggcagcttgtgatagcacgccagaaggtcaaggatgcagagaaacagtatgagaaggatcctgacgatttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggcgatcatctcaaggaaagatcagcattaagctatgggaatacactggacctgaatagtcttgacattgatgaacctacaggacagacagctgattggttgaccataattgtctatctgacatcattcgtggtcccgatcatcttgaaggcactgtatatgttaacaacaagaggtaggcagacttcaaaggacaacaaggggatgaggatcaggttcaaggatgacagctcatatgaggatgtcaatgggattagaaagcctaaacatctgtatgtgtcaatgccaaacgcccaatttagcatgaaggctgaagagataacacctggaagattccgtactgcagtatgtgggctatatcctgcacagataaaggcaaggaacatggtaagtcctgtcatgagtgtagttgggtttttggcactggcaaaagactggacatctagaattgaagaatggcttggcgcaccctgcaagttcatggcagagtctcccattgccgggagtttatctgggaatcctgtaaaccgtgactatatcagacagagacaaggtgcacttgcagggatggagccaaaggaatttcaagccctcaggcaacattcaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatcttggtgatgacatggatccagagctacgtagcctggctcagatcttgattgaccagaaagtgaaggaaatttcaaaccaggaacctatgaaattataa

SEQ ID NO: 2837 - RNA, 1290 nt, synthetic construct
  misc_feature 1..1290: note = derived and/or modified CDS sequence (wt) from SEOV(Singapore/06(RN41))__GQ274944.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgttgcagcttcaatacaatcaaaaattgatgaactgaagcgccaacttgccgacaggattgcagcagggaaaaacatcgggcaagaccgggatcctacaggggtagagccaggtgatcatctcaaggaaagatcagcactaagctatgggaatacactggacttgaatagtctcgacattgatgaacctacaggacagacagctgattggttgaccataattgtctatctgacatcattcgtggtcccaatcatcttgaaggcactgtacatgttaacaacaagaggtaggcagacttcaaaggacaacaaggggatgaggatcaggttcaaggatgacagctcatatgaggatgtcaacggaatcagaaagcccaaacatttgtatgtgtcaatgccaaacgcccagtccagcatgaaggctgaagagataacacctggaagattccgcactgcagtatgtgggctatatcctgcacagataaaggcaaggaacatggtaagccctgtcatgagtgtagttgggtttttggcactggcaaaagactggacatctagaattgaagaatggcttggcgcaccctgcaagttcatggcggagtctcccattgccgggagtttatctgggaatcctgtgaatcgtgattatatcagacagagacaaggtgcacttgcagggatggagccaaaggaatttcaagccctcaggcaacattcaaaggatgctggatgtacactggttgaacatattgagtcaccatcatcaatatgggtgtttgctggggcccctgataggtgtccaccaacatgtttgtttgtcggagggatggctgagttaggtgccttcttttccatacttcaggatatgaggaacacaatcatggcttcaaaaactgtaggaacagctgatgaaaagcttcgaaagaaatcatcattctaccaatcatacctcagacgcacacaatcaatgggaatacaactggatcagaggataattgttatgtttatggttgcctggggaaaggaggcagtggacaactttcatctcggtgatgacatggatccagagcttcgtggcctggctcagatcttgattgaccagaaagtgaaggaaatctcgaaccaggaacctatgaaattataa

SEQ ID NO: 2838 - RNA, 1290 nt, synthetic construct
  misc_feature 1..1290: note = derived and/or modified CDS sequence (wt) from SEOV(YaluRiver12)__HQ611980.1__N
  source 1..1290: mol_type = other RNA
atggcaactatggaggaaatccagagagagatcagtgctcacgaggggcagcttgtgatagcacgccagaaggtcaaggatgcagaaaagcagtatgagaaggatcctggtgacctaaacaagagggcactgcatgatcgggagagtgtcgcagcttcgatacaatcaaaaatcgatgaattgaagcgccagcttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacagcaaggggatgaggatcagattcaaggatgacagctcatatgaggatgtcaatggaatcagaaagcccaaacatctgtatgtgtcaatgccaaacgcccaatccagcatgaaaactgaagagataacacctggaaggttccgcacggcagtatgtgggctgtatcctgcacagataaaggcaaggaacatggtaagccctgtcatgagtgtagttggttttttggcactggcaaaagactggacatcaagaattgaagaatggcttggcgcaccctgcaagttcatggcagagtctcccattgccgggagtttatctgagaatcctgtgaatcgggactatatcagacaaagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtcccccaacatgcttgtttgtcggagggatggccgagttaggtgccttcttttctatccttcaggatatgaggaacacaatcatggcttcaaaaactgtgggcacagctgatgaaaagcttcgaaagaaatcatcattttatcaatcatacctcagacgcacacaatcaatgggaatacaactggaccagaggataattgttatgtttatggttgcctggggaaaggaggcagtggacaactttcatctcggtgatgacatggatccagagcttcgtagcctggctcagatcctgattgaccagaaagtgaaggagatctcaaaccaggaacctatgaaattgtaa

SEQ ID NO: 2839 - RNA, 1290 nt, synthetic construct
  misc_feature 1..1290: note = derived and/or modified CDS sequence (wt) from SEOV(14D12)__AB618124.1__N
  source 1..1290: mol_type = other RNA
atggcaactatggaagaaatccagaaagaaatcagtgctcacgaggggcagcttgtgatagcacgccagaaggtcaaggatgcagaaaagcagtatgagaaggatcctgatgacttaaacaagagggcactgcatgatcgggaaagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacttgaatagtcttgacattgatgaacctacaggacagacagctgattggttgaccataattgtctatctgacatcattcgtggtcccgatcatcttgaaggcactgtacatgttgacaacaagaggtaggcagacttcaaaggacaacaaggggatgagaatcaggttcaaggatgatagctcatatgaggatgtcaacggaatcagaaagcctaaacatttgtatgtgtcaatgccaaatgcccagtccagcatgaaggctgaagagataacacctggaagattccgcactgcagtatgtgggctatatcctgcacagataaaggcaaggaacatggtaagccctgtcatgagtgtagttgggtttttggcactggcaaaggactggacatctagaattgaagaatggcttggcgcaccctgcaagttcatggcggagtctcccattgccgggagtttatctgggaatcctgtaaatcgtgactatatcagacagagacaaggtgcacttgcagggatggagccaaaggaatttcaagccctcaggcaacattcaaaggatgctggatgtacactggttgaacatattgagtcaccatcatcaatatgggtgtttgctggggcccctgataggtgtccaccaacatgtttgtttgtcggagggatggctgagttaggtgccttcttttccatacttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggatccagagcttcgtagcctggctcagatcctgattgatcaaaaagtgaaggaaatttcgaaccaggaacctatgaaattataa

SEQ ID NO: 2840 - RNA, 1281 nt, synthetic construct
  misc_feature 1..1281: note = derived and/or modified CDS sequence (wt) from SEOV(19CSG)__AB618114.1__N
  source 1..1281: mol_type = other RNA
atggaagaaatccagagagaaatcagtgctcacgaggggcagcttgtgatagcacgccagaaggtcaaggatgcagaaaagcagtatgaaaaggatcctgatgacttaaacaagagggcactgcatgatcgggaaagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacttgaatagtcttgacattgatgaacctacaggacagacagctgattggttgaccataattgtctatctgacatcattcgtggtcccgatcatcttgaaggcactgtatatgttaacaacaagaggtaggcagacttcaaaggacaacaaggggatgagaatcaggttcaaggatgacagctcatatgaggatgtcaacggaatcagaaagcccaaacatttgtatgtgtcaatgccaaacgcccagtccagcatgaaggctgaagagataacacctggaagattccgcactgcagtatgtgggctatatcctgcacagataaaggcaagaaacatggtaagccctgtcatgagtgtagttggttttttggcactggcaaaggactggacatctagaattgaagaatggcttggcgcaccctgcaagttcatggcggagtctcccattgccgggagtttatctgggaatcctgtaaatcgtgactatatcagacagagacaaggtgcacttgcagggatggagccaaaggaatttcaagccctcaggcaacattcaaaggatgctggatgtacactggttgaacatattgagtcaccatcatcaatatgggtgtttgctggggcccctgataggtgtccaccaacatgcttgtttgtcggagggatggctgagttaggtgccttcttttccatacttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggatccagagcttcgtagcctggctcagatcctgattgatcaaaaagtgaaggaaatctcgaaccaggaacctatgaaattataa

SEQ ID NO: 2841 - RNA, 1290 nt, synthetic construct
  misc_feature 1..1290: note = derived and/or modified CDS sequence (wt) from SEOV(93HBX12)__EF192308.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccaggtgatcatctcaaggaaaggtcagcactgagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaataaggggatgaggatcagattcaaggatgacagctcatatgaggatgtcaatggaatcggaaagcccaaacatctgtatgtgtcaatgccaaacgcccaatccagcatgaaagctgaagagataacacctggaagattccgcacggcagtctgtgggctatatcctgcacagataaaggcaaggaacatggtaagccctgtcatgagtgtagttgggtttttggcactggcaaaagactggacatctagaattgaagaatggcttggtgcaccctgcaagtttatggcggaatctcccattgccgggagtttatctgggaatcctgtgaatcgtgactatatcagacagagacaaggtgcacttgcaggaatggagccaaaggaatttcaagccctcaggcaacattcaaaggatgctggatgtacactggttgaacatattgagtcaccatcgtcaatatgggtgtttgctggggcccctgataggtgtccaccaacatgcctgtttgtcggagggatggctgaattaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagagaataattgttatgtttatggttgcctggggaaaggaggcagtggacaactttcatctcggtgatgacatggatccagagctccgtggcctggctcagatcctgattgaccagaaagtgaaggaaatctcaaaccaggaacctatgaaattataa

SEQ ID NO: 2842 - RNA, 1290 nt, synthetic construct
  misc_feature 1..1290: note = derived and/or modified CDS sequence (wt) from SEOV(Cherwell)__KC626089.1__N
  source 1..1290: mol_type = other RNA
atggcaactatggaagaaatccagagagaaatcagtgctcacgaggggcagcttgtgatagcacgccagaaagtcaaggatgcagaaaaacagtatgagaaggatcctgatgacttaaataagagggcactgcatgatcgggagagtgtcgcagcttcaatacagtcaaaaattgatgaattgaagcgccaacttgctgacaggattgcagcaggaaagaacatcgggcaagaccgggatcctacaggggtagagccgggtgatcatctcaaggaaagatcagcactaagctacgggaatacactggacctgaatagccttgacattgatgaacctacaggacagacagctgattggctgaccataattgtctatttgacatcatttgtggtcccgatcatcttgaaggcactgtacatgttaacaacaagaggcaggcagacttcaaaggacaacaaggggatgaggatcagattcaaggatgacagctcatatgaagatgtcaatggaatcagaaagcccaaacatctgtatgtgtcaatgccaaacgcccaatccagcatgaaggctgaagagataacacctggaagattccgcactgcagtatgtgggctatatcctgcacaaataaaagcaaggaacatggtaagccctgtcatgagtgtagttgggttcttggcactggcaaaagactggacatctagaattgaagaatggcttggcgcaccctgcaagttcatagcagagtcccccattgccgggagtttatctgggaatcctgtgaatcgtgattatatcagacagagacaaggtgcacttgcagggatggagccaaaggaatttcaagctctcaggcaacattcaaaggatgctggatgtacactggttgaacatattgagtcaccatcatcaatatgggtgtttgctggggcccctgataggtgtccaccaacatgcttgtttgttggagggatggctgagttaggtgccttcttttctatacttcaggatatgaggaacacaatcatggcttcaaaaactgtgggtacagctgatgaaaagcttcggaagaaatcatcattctatcaatcataccttagacgcacacagtcaatgggaatacaactggatcagaggataattgttatgttcatggttgcctggggaaaggaggcagtggacaactttcatcttggtgatgacatggatccagagcttcgtagcctggctcagatcctgattgaccagaaagtgaaggaaatctcaaaccaggaacctatgaaattgtaa

SEQ ID NO: 2843 - RNA, 1290 nt, synthetic construct
  misc_feature 1..1290: note = derived and/or modified CDS sequence (wt) from SEOV(CixiRf23)__FJ803201.1__N
  source 1..1290: mol_type = other RNA
atggcaactatggaagaaatccagagagaaatcagtgctcacgaggggcagcttgtgatagcacgccagaaagtcaaggatgcagaaaagcagtatgaaaaggatcctgatgacttaaacaagagggcactgcatgatcgggagagtgtcgcagcttcaatacaatcaaaaattgatgaattgaagcgccaacttgccgacaggattgcagcagggaagaatattgggcaagaccgggatcctacaggggtagaaccgggtgatcatctcaaagaaagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcaaacttcaaaggacaacaaagggatgaggatcagattcaaggatgacagctcatatgaggatgtcaatggaatcagaaagcccaaacatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtagttgggtttttggcactggcaaaagattggacatctagaattgaagaatggcttggtgcaccctgcaagttcatggcggaatctccaattgctgggagtttatctgggaatcccgtgaatcgtgactatatcagacagagacaaggtgcacttgcagggatggagccaaaggaatttcaagccctcaggcaacatgcaaaggatgctgggcgtacactggttgagcatattgagtcaccatcatcaatatgggtgtttgctggtgcccctgataggtgtccaccaacatgtttgtttgtcggagggatggctgagttaggtgccttcttttctatacttcaggatatgaggaatacaatcatggcttcaaaaactgtgggcacagctgatgaaaagcttcgaaagaaatcatcattctatcaatcgtacctcagacgcacacaatcaatgggaatacaactggaccagaggataattgttatgttcatggttgcctggggaaaggaggcagtggacaactttcatctcggtgatgacatggacccagagcttcgtagcctggctcagattctgattgaccagaaagtaaaagaaatctcgaaccaggaacctatgaaattataa

SEQ ID NO: 2844 - RNA, 1290 nt, synthetic construct
  misc_feature 1..1290: note = derived and/or modified CDS sequence (wt) from SEOV(CixiRf56)__FJ803202.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagccttgacattgatgaacctacaggacagacagctgattggttgaccataattgtctatctgacatcatttgtggtcccaatcatcttgaaggcactgtacatgttaacaacaagaggtaggcagacttcaaaggacaacaaggggatgaggatcagatttaaggatgacagctcatatgaggatgtcaatggaatcagaaagcccaaacatctctatgtgtcaatgccaaacgcccaatccagcatgaaagctgaagagataacacctggaagattccgcacagcagtgtgtgggttatatcctgcacagataaaggcaagaaacatggtaagccctgtcatgagtgtagttgggtttttggcactggcaaaagactggacatctagaattgaagaatggcttggcgcaccctgcaagttcatggcagagtctcccattgccgggagtttatctgggaatcctgtgaatcgtgactatatcagacagggacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcctctcgttcatgacatggatccaaagcttcgtagcctgtctcagatcctgattgaccaaaaagtgaatgaaatctcaaaccaggaacctatgaaattataa

SEQ ID NO: 2845 - RNA, 1290 nt, synthetic construct
  misc_feature 1..1290: note = derived and/or modified CDS sequence (wt) from SEOV(CixiRn21)__FJ803205.1__N
  source 1..1290: mol_type = other RNA
atggcaactatggaagaaatccagagagaaatcagtgctcacgaggggcagcttgtgatagcacgccagaaggtcaaggatgcagaaaagcaatatgagaaggatcctgatgacttaaacaagagggcactgcatgatcgggagagtgtcgcagcttcaatacaatcaaaaattgatgagttgaagcgccaacttgccgacaggattgcagcagggaagaacatcgggcaagaccgggatcctacaggggtagagccaggtgatcatctcaaggaaagatcagcactaagctatgggaatacactggacctgaatagtcttgacattgatgaacctacaggacagacagctgattggctgaccataatcgtctatctgacatcattcgtggtcccgatcatcttgaaggcattgtacatgttaacaacgagaggtaggcagacttcaaaggacaacaaggggatgaggatcagatttaaggatgacagctcatatgaggacgtcaatggaatcagaaagcccaaacatctgtatgtgtcaatgccaaacgcccaatccagcatgaaagctgaagagataacacctggtagattccgcacggcagtctgtgggttatatcctgcacagataaaggcaagaaacatggtaagccctgtcatgagtgtggttgggtttttggcactggcaaaagactggacatctagaattgaagaatggcttggcgcaccctgcaaatttatggcggaatctcccattgccgggagtttatctgggaatcccgtgaatcgtgactatatcagacagagacaaggtgcacttgcaggaatggagccaaaggaatttcaagccctcaggcaacattcaaaggatgctggatgtacactggttgaacatattgagtcaccatcgtcaatatgggtgtttgctggggcccctgataggtgtccaccaacatgcttgtttgtcggagggatggatgagttaggtgccttcttttctatccttcaggatatgaggaacacgatcatggcttcaaaaactgtgggcacagctgatgaaaaacttcgaaagaaatcatcattctatcaatcatacctcagacgcacacaatcaatgggaatacaactggaccacaggataattgttatgttcatggttgcctggggaaaggaggcagtggacaacttccatctcggtgatgacatggatccagagcttcgtaccctggctcagatcctgattgaccagaaagtgaaggaaatctcaaaccaggaacctatgaaattataa

SEQ ID NO: 2846 - RNA, 1290 nt, synthetic construct
  misc_feature 1..1290: note = derived and/or modified CDS sequence (wt) from SEOV(CixiRn76)__FJ803206.1__N
  source 1..1290: mol_type = other RNA
atggcaactatggaagaaatccagagagaaatcagtgctcacgaggggcagcttgtgatagcacgccagaaggttaaggatgcagaaaagcagtatgagaaggatcctgatgacttaaacaagagggcactgcatgatcgggaaagtgtcgcagcttcaatacaatcaaaaattgatgaattgaagcgccaacttgccgacaggattgcagcagggaaaaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccgatcattttgaaggcactgtacatgttaacaacaagaggtaggcagacttcaaaggacaacaaggggatgaggatcagattcaaggatgacagctcatatgaggatgtcaatggaatcagaaagcccaaacatttgtatgtgtcaagccaaaacgcccaatccagcatgaaagctgaagagataacacctggaagattccgcacagcagtgtgtgggttatatcctgcacagataaaggcaagaaacatggtaagccctgtcatgagtgtagttgggtttttggcactggcaaaagactggacatctagaattgaagaatggcttggcgcaccctgcaagttcatggcagagtctcccattgccgggagtttatctgggaatcctgtgaatcgtgactatatcagacagggacaaggtgcacttgcaggaatggagccaaaggaatttcaagccctcaggcaacatgcaaaggatgctggatgtacactggttgaacatattgagtcaccatcgtcaatatgggtgtttgctggggcccgtgataggtgtccaccaacatgcttgtttgtcggaggtatggctgagttaggtgccttcttttctatccttcaggatatgaggaacacaatcatggcttcaaaaactgtgggcacggctgatgaaaagcttagaaagaaatcatcattctatcaatcatacctcagacgcactcaatcaatgggaatacaactggaccagaggataattgttatgtttatggttgcctggggaaaggaggcagtggataactttcatctcggtgatgacatggatccagagcttcgtagcctggctcagatcctgattgaccagaaagtgaaggaaatctcaaaccaggaacctatgaaattataa

SEQ ID NO: 2847 - RNA, 1290 nt, synthetic construct
  misc_feature 1..1290: note = derived and/or modified CDS sequence (wt) from SEOV(CUI)__GQ279395.1__N
  source 1..1290: mol_type = other RNA
atggctactatggaggaattacagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccaggtgatcatctcaaggaaagatcagcactgagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaataaggggatgaggatcagattcaaggatgacagctcatatgaggatgtcaatggaatcagaaagcccaaacatctgtatgtgtcaatgccaaacgcccaatccagcatgaaagctgaagagataacacctggaagattccgcacggcagtctgtgggctatatcctgcacagataaaggcaaggaacatgttaagccctgtcatgagtgtagttgggtttttggcactggcaaaagactggacatctagaattgaagaatggcttggtgcaccctgcaagtttatggcggaatctcccattgccgggagtttatctgggaatcctgtgaatcgtgactatatcagacagagacaaggtgcacttgcaggaatggagccaaaggaatttcaagccctcaggcaacattcaaaggatgctggatgtacactggttgaacatattgagtcaccatcgtcaatatgggtgtttgctggggcccctgataggtgtccaccaacatgcctgtttgtcggagggatggctgaattaggtgccttcttttctatccttcaggatatgaggaacacaatcatggcttcaaaaactgtgggcacagctgataaaaagcttcgaaagaaatcatcattctatcaatcatacctcagacgcacacaatcaatgggaatacaactggaccagagaataattgttatgtttatgtttgcctggggaaaggaggcagtggacaactttcatctcggtgatgacatggatccagagctccgtggcctggctcagatcctgattgaccagaaagtgaaggaaatctcaaaccaggaacctatgaaattataa

SEQ ID NO: 2848 - RNA, 1290 nt, synthetic construct
  misc_feature 1..1290: note = derived and/or modified CDS sequence (wt) from SEOV(FeixianRn1)__GU592942.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccaatcatcttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaacgcccaatcaagcatgaaagctgaagagataacacctggaagattccgcacggcagtatgtgggttatatcctgcacagataaaggcaaggaacatggtaagccctgtcatgagtgtagttgggtttttggcactggcaaaagactggacatctagaattgaagaatggcttggcgcaccctgcaagttcatggcagagtctcccattaccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatggatccagagcttcgtagcctggctcagatcctgattgaccagaaagtgaaggaaatctctaaccaggaacctatgaaactataa

SEQ ID NO: 2849 - RNA, 1290 nt, synthetic construct
  misc_feature 1..1290: note = derived and/or modified CDS sequence (wt) from SEOV(GanyuRn66)__GU592932.1__N
  source 1..1290: mol_type = other RNA
atggcaactatggaagaaatccagagagaaatcagtgctcacgaggggcagcttgtgatagcacgccagaaagtcaaggatgcagaaaagcagtatgaaaaggatcctgatgacttaaacaagagggcactgcatgatcgggagagtgtcgcagcttcaatacaatcaaaaattgatgaattgaagcgccaacttgccgacaggattgcagcagggaagaatattgggcaagaccgggatcctacaggggtagagccgggtgatcatctcaaagaaagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcaaacttcaaaggacaacaaagggatgaggatcagattcaaggatgacagctcatatgaggatgtcaatggaatcagaaagcccaaacatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtagttgggtttttggcactggcaaaagattggacatctagaattgaagaatggcttggtgcaccctgcaagttcacggcggaatctccaattgctgggagtttatctgggaatcccgtgaatcgtgactatatcagacagagacaaggtgcacttgcagggatggagccaaaggaatttcaagccctcaggcaacatgcaaaggatgctgggtgtacactggttgagcatattgagtcaccatcatcaatatgggtgtttgctggggcccctgataggtgtccaccaacatgtttgtttgtcggagggatggctgagttaggtgccttcttttctatacttcaggatatgaggaatacaatcatggcttcaaaaactgtgggcacagctgatgaaaagcttcgaaagaaatcatcattctatcaatcgtacctcagacgcacacaatcaatgggaatacaactggaccagaggataattgttatgtttatggttgcctggggaaaggaggcagtggacaactttcatctcggtgatgacatggacccagagcttcgtagcctggctcagatcctgattgaccagaaagtaaaagaaatctcgaaccaggaacctatgaaattataa

SEQ ID NO: 2850 - RNA, 1290 nt, synthetic construct
  misc_feature 1..1290: note = derived and/or modified CDS sequence (wt) from SEOV(Gongzhuling108)__KF745947.1__N
  source 1..1290: mol_type = other RNA
atggcaactatggaagaaatccagagagaaatcagtgctcacgaggggcagcttgtgatagcacgccagaaggttaaggatgcagaaaagcagtatgagaaggatcctgatgacttaaacaagagtgcactgcatgatcgggagagtgtcgcagcttcaatacaatcaaaaattgatgaattgaagcgccaacttgccgacaggattgcagcagggaagaacatcgggcaagaccgggatcctactggggtagagcctggtgatcatctcaaggaaagatcagcactaagctatgggaatacactggacctgaatagtcttgacattgatgaacctacaggacagacagctgattggttgaccatacttgtctatctgacatcattcgtggtcccgatcatcttgaaggcactgtacatgttaacaacaagaggtaggcagacttcaaaggacaacaagggaatgaggatcagattcaaggatgacggctcatatgaggatgttaacggaattagaaagcccaaacatctgtatgtgccaatgccaaacgcccaatccagcatgaaagctgaagagataacacctggaagattccgcacggcagtatgtgggttatatcctgcacagataaagccaaggaacatggtaagccctgtcatgagtgtagttgggtttttggcactggctaaagactggacatctagaattgaagaatggcttggcgcaccctgcaagttcatggcggagtctcccattgccgggagtttatctgggaatcctgtgaatcgtgactatatcaggcagagacaaggtgcacttgcaggaatggagccaaaggaatttcaagccctcaggcaacatgcaaaggatgctggatgtacactggttgaacatattgagtcaccatcgtcaataagggtgtttgctggggcccctgctaggtgtccaccaacatgcttgtttgtcggaggtatggctgagctaggtgcctttttttctatccttcaggatatgaggaacacaattatggcttctaagactgtgggcacagctgatgaaaagcttcgaaagaaatcatcattctatcaatcatacctcagacgctcacaatcaatgggaatacaactggaccagaggataattgttatgtttatggtcgcctcgggaaaggaggcagtggacaactttcatctcggtgatgacatggatccagagcttcgtagtctggttcagatcctgattgaccagaaagtgaaggaaatctcaaaccaggaacctatgaaattataa

SEQ ID NO: 2851 - RNA, 1290 nt, synthetic construct
  misc_feature 1..1290: note = derived and/or modified CDS sequence (wt) from SEOV(Gongzhuling147)__KF745948.1__N
  source 1..1290: mol_type = other RNA
atggcaactatggaagaaatccagagagaaatcagtgctcacgaggggcagctcgtgatagcacgccagatcgttaaggatgcagaaaagcagtatgagaaggatcctgctgacttaaacaagagagcactgcatgatcgggagagtgtggcagcttcaatacaatcaaaaattgatgaattgaagcgccatcttgccgacagaattgcagcagggaagaacatcgggcaagaccgggatcctacaggggtagagcctggtgatcatctcaaggaaagatcagcactaagctatgggaatacactggacctcaatagtcttgacattgatgaacctacaggacagacagctgattggttgaccataattgtctatctgacatcattcgtggtcccgatcatcttgaaggcactgtacatcttaacaacaagtggtaggcagacttcaaaggacaacaagggaatgaggatcagattcaaggatgacagctcatatgaggatgttaacggaattagaatgcccaaacatctgtatgtgccaatgccaaacgcccaatccagcatgaaagctgaagatataacacctggaagattccgcacggcagtatgtgggctatatcctgcacagataaaggcaaggaacatggtaagccctctcatgagtgtagttgggtttttggcactgccaaaagactggacatctagaattgatgaatggcttggcgcaccctgcaagttcatggcggagtctcccattgccgggagtttatctgggaatcctgtgaatcgtgaccatatcagacagagacaaggtgcacttgcaggaatggatccaaaggaatttcaagcggtcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgccttttttactatccttcaggatatgaggaacacaattatgccttctaagactgtgggcacagctgatgaaaagcttcgaaagaaatcatcgttctatcaatcatacctcagacgcacacaatcaatgggaatacaactggaccagaggataattgttatctttatggtcgcctgggcaaaggaggcagtggacaactttcatctcggtgatgacatggatccagagcttcgtagtctggctcagatcctgattgaccagaaagtgaaggaaatctcaaaccaggtacctatgaaattataa

SEQ ID NO: 2852 - RNA, 1290 nt, synthetic construct
  misc_feature 1..1290: note = derived and/or modified CDS sequence (wt) from SEOV(Gongzhuling415)__KF745949.1__N
  source 1..1290: mol_type = other RNA
atggcaactatggaagaaatccagagagaaatcagtgctcacgaggggcagctcgtgatagcacgccagatggttaaggatgcagaaaagcagtatgagaaggatcttgctgacttaaacaagagagcactgcatgatcgggagagtgtggcagcttcaatacaatcaaaaattgatgaattgaagcgccaacttgccgacagaattgcagcagggaagaacatcgagcaagaccgggatcctacaggggtagagcctggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatcttaacaacaagaggtaggcagacttcaaaggacaacaagggaatgacgatcagattcaaggatgacagctcatatgaggatgttaacggaattagaatgcccaaacatctgtatgtgccaatgccaaacgcccaatccagcatgaaagctgaagatataacacctggaagattccgcacggcagtatgtgggctatatcctgcacagataaaggcaaggaacatggtaagccctctcatgagtgtagttgggtttttggcactgccaaaagactggacatctagaattgatgaatggcttggcgcaccctgcaagttcatggcggagtctcccattgccgggagtttatctgggaatcctgtgaatcgtgaccatatcagacagagacaaggtgcacttgcaggaatggatccaaaggaatttcaagcggtcaggcaacatgcaaaggatgctggatgtacactggttgaacatattgagtcaccatcgtcaatatgggtgtttgctggggcccctgataggtgtctaccaacatgcttgtttgtcggaggtatggctgagttaggtgccttttttactatccttcaggatatgaggaacacaattatggcttctaagactgtgggcacagctgatgaaaagcttggaaagaaatcatcgttctatcaatcatacctcagacgcacacaatcaatgggaatacaactggaccagaggataattgttatgtttatggtcgcctgggcaaaggaggcagtggacaacattcatctcggtgatgacatggatccagagcttcgtagtctggctcagatcctgattgaccagaaagtgaaggaaatctcaaaccaggtacctatgaaattataa

SEQ ID NO: 2853 - RNA, 1290 nt, synthetic construct
  misc_feature 1..1290: note = derived and/or modified CDS sequence (wt) from SEOV(Gongzhuling42)__KF745942.1__N
  source 1..1290: mol_type = other RNA
atggcaactatggaagaaatccagagagaaatcagtgctcacgaggggcagcttgtgatagcacgccagaaggttaaggatgcacaaaagcagtatgagaaggatcctgatgacttaaacaagagagcactgcatgatcgggagagtgtcgcagcttcaatacaattaaaaattgatgaattgaagcgccaacttgccgacaggattgcagcagggaagaacatcgggcaagaccgggatcctacaggggtagagcctggtgatcatctcaaggaaagatcagcactaagctatgggaatacactggacctgaatagtcttgacattgatgaacctacaggacagacagctgattggttgaccataattgtctatttgacatcattcgtggtcccgatcatcttgaaggcactgtacatgttaacaacaagaggtaggcagacttcaaaggacaacaagggaatgaggatcagattcaaggatgacagctcatatgaggatgttaagggaattagaaagcccaaacatctgtatgtgccaatgccaaacgcccaatccagcatgaaagctgaagagataacacctggaagatgccgcacggcagtatgtgggctatatcctgcacagataaaggcaaggaacatggtaagccctgtcatgagtgcagttgggattttggcactggcaaaagattggacatctagaattgaagaatggcttggcacaccctgcaagttcatggcggagtctcccattgccgggagtttatctgggaatcctgtgaatcgtgaccatatcagacagagacaaggtgcacttgcaggaatggagccaaaggaatttcaaggcctcaggcaacatgcaaaggatgctggatgtacactggttgaacacattgagtcaccatcgtcaatatgggtgtttgctggggcccctgataggtgtccaccaacatgcttgtttgtcggaggtatggctgagttaggtgccttttttgctatccttcaggatatgaggaacacaattatggcttctaagactgtgggcacagctgatgaaaagcttcgaaagaaatcatcattctatcaatcatacctcaggcgcacacaatcaatgggaatacaactggaccagaggataattgttatgtttatggtcgcctgggcaaaggaggcagtggacaactttcatctcggtgatgacatggatccagagcttcgtagtctggctcagatcctgatggaccagaaagtgaaggaaatctcaaaccaggaacctatgaaattataa

SEQ ID NO: 2854 - RNA, 1290 nt, synthetic construct
  misc_feature 1..1290: note = derived and/or modified CDS sequence (wt) from SEOV(Gongzhuling45)__KF745943.1__N
  source 1..1290: mol_type = other RNA
atggcaactatggaagaaatccagagagaaatcagtgctcacgaggggcagctggtgatagcacgccagatggttaaggatgcagaaaagcagtatgagaaggatcctgctgacttaaacaagagagcactgcatgatcgggagagtgtggcagcttcaatacaatcaaaaattgatgaattgaagcgccaacttgccgacagaattgcagcagggaagaacatcgggcaagaccgggatcctacaggggtagagcctggtgatcatctcaaggaaagatcagcactaagctatcggaatacactggacctgaatagtcttgacattgatgaacctacaggacagacagctgattggttgaccataattgtctatctgacatcattcgtggtcccgatcatcttgaaggcactgtacatcttaacaacaagaggtaggcagacttcaaaggacaacaagggaatgaggatcagattcaaggatgacagctcatatgaggatgttaacggaattagaatgcccaaacatctgtatttgccaatgccaaacgcccaatccagcatgaaagctgaagatataacacctggaagattccgcacggcagtatgtgggctatatcctgcacagataaaggcaaggaacatggtaagccctctcatgagtgtagttgggtttttggcactgccaaaagactggacatctagaattgatgaatggcttggcgcaccctgcaagttcatggcggagtctcccattgccgggagtttatctgggaatcctgtgaatcgtgaccatatcagacagagacaaggtgcacttgcaggaatggatccaaaggaatttcaagcggtcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgccttttttactatccttcaggatatgcggaacacaattatggcttctaagactgtgggcacagctgatgaaaagcttcgaaagaaatcatcgttctatcaatcatacctcagacgcacacaatcaatgggaatacaactggaccagcggataattgttatgtttatggtcgcctgggcaaaggaggcagtggacaactttcatctcggtgatgacatggatccagagcttcgtagtctggctcagatcctgattgaccacaaagtgaaggaaatctcaaaccaggtacctatgaaattataa

SEQ ID NO: 2855 - RNA, 1290 nt, synthetic construct
  misc_feature 1..1290: note = derived and/or modified CDS sequence (wt) from SEOV(Gongzhuling58)__KF745944.1__N
  source 1..1290: mol_type = other RNA
atggcaactatggaagaaatccagagagaaatcagtgctcacgaggggcagctcgtgatagcacgccagatggttaaggatgcagaaaagcagtatgagaaggatcctgctgacttaaacaagagagcactgcatgatcgggagagtgtggcagcttcaatacaatcaaaaattgatgaattgaagcgccaacttgccgacagaattgcagcagggaagaacatcgggcaagaccgggatcctacaggggtagagcctggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatcttaacaacaagaggtaggcagacttcaaaggacaacaagggaatgaggatcagattcaaggatgacagctcatatgaggatgttaacggaattagaatgcccaaacatctgtatgtgccaatgccaaacgcccaatccagcatgaaagctgaagatataacacctggaagattccgcacggcagtatgtgggctatatcctgcacagataaaggcaaggaacatggtaagccctctcatgagtgtagttgggtttttggcactgccaaaagactggacatctagaattgatgaatggcttggcgcaccctgcaagttcatggcggagtctcccattgccgggagtttatctgggaatcctgtgaatcgtgaccatatcagacagagacaaggtgcacttgcaggaatggatccaaaggaatttcaagcggtcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgccttttttactatccttcaggatatgaggaacacaattatggcttctaagactgtgggcacagctgatgaaaagcttcgaaagaaatcatcgttctatcaatcatacctcagacgcacacaatcaatgggaatacaactggaccagaggataattgttatgtttatggtcgcctgggcaaaggaggcagtggacaactttcatctcggtgatgacatggatccagagcttcgtagtctggctcagatcctgattgaccagaaagtgaaggaaatctcaaaccaggtacctatgaaattataa

SEQ ID NO: 2856 - RNA, 1290 nt, synthetic construct
  misc_feature 1..1290: note = derived and/or modified CDS sequence (wt) from SEOV(Gongzhuling85)__KF745945.1__N
  source 1..1290: mol_type = other RNA
atggcaactatggaagaaatccagagagaaatcagtgctcacgaggggcagctcgtgatagcacgccagatggttaaggatgcagaaaagcagtatgagaaggatcctgctgacttaatcaagagagcactgcatgatcgggagagtgtggcagcttcaatacaatcaaaaattgatgaattgaagcgccaacttgccgacagaattgcagcagggaagaacatcgggcaagaccgggatcctacagggctagagcctggtgatcatctcaaggaaagatcagcactaagctatgggaatacactggacctgaatagtcttgacattgatgaacctacaggacagacagctgattggttgaccgtaattgtctatctgacatcattcgtggtcccgatcatcttgaaggcactgtacatcttaacaacaagaggtaggcagacttcaaaggacaacaagggaatgaggatcagattcaaggatgtcagctcatatgaggatgttaacggaattagaatgcccaaacatctgtatgtgccaatgccaaacgcccaatccagcatgaaagctgaagatataacacctggaagattccgcacggcagtatgtgggctatatcctgcacagataaaggcaaggaacatggtaagccctctcatgagtgtagttgggtttttggcactgccaaaagactggacatctagaattgatgaatggcttggcgcaccctgcaagttcatggcggagtctcccattgccgggagtttatctgggaatcctgtgaatcgtgaccatatcagacagagacaaggtgcacttgcaggaatggatccaaaggaatttcaagcggtcaggcaacatgcaaaggatgctggatgtacactggttgaacatattgagtcaccatcgtcaatatgggtgtttgctggggcccctgataggtgtccaccaacatgcttgtttgtccgaggtatggctgagttaggtgccttttttactatccttcaggatatgaggaacacaattatggcttctaagactgtgggcacagctgatgaaaagcttcgaaagaaatcatcgttctatcaatcatacctcagacgcacacaatcaatgggaatacaactggaccagaggataattgttatgtttatggtcgcctgggcaaaggaggcagtggacaactttcatctcggtgatgacatgcatccagagcttcgtagtctggctcagatcctgattgaccagaaagtgaaggaaatctcaaaccaggtacctatgaaattataa

SEQ ID NO: 2857 - RNA, 1290 nt, synthetic construct
  misc_feature 1..1290: note = derived and/or modified CDS sequence (wt) from SEOV(Gongzhuling97)__KF745946.1__N
  source 1..1290: mol_type = other RNA
atggcaactatggaagaaatccagagagaaatcagtgctcacgaggggcagctcgtgattgcacgccagatggttaaggatgcagaaaagcagtatgagaaggatcctgctgacttaaacaagagagcactgcatgatcgggagagtgtggcagcttcaatacaatcaaaaattgatgatttgaagcgccaacttgccgacagaattgcagcagggaagaacatcgggcaagaccgggatcctacaggggtagagcctggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaacaagggaatgaggatcagattcaaggatgacagctcatatgaggatgttaacggaattagaatgcccaaacatctgtatgtgcgaatgccaaacgcccaatccagcatgaaagctgaagatataacacctggaagattccgcacggcagtatgtgggctatatcctgcacagataaaggcaaggaacatggtaagccctctcatgagtgtagttgggtttttggcactgccaaaagactggacatctagaattgatgaatggcttggcgcaccctgcaagttcatggcggagtctcccattgccgggagtttatctgggaatcctgtgaatcgtgaccatatcagacagagacaaggtgcacttgcaggaatggatccaaaggaatttcaagcggtcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgccttttttactatccttcaggatatgaggatcacaattatggcttctaagactgtgggcacagctgatgaaaagcttcgaaagaaatcatcgttctatcaatcatacctcagacgcacacaatcaatgggaatacaactggaccagaggttaattgttatgtttatggtcgcctgggcaaaggaggcagtggacaactttcatctcggtgatgacatggatccagagcttcgtagtctggctcagatcctgattgaccagaaagtgaagcaaatctcaaaccaggtacctatgaaattataa

SEQ ID NO: 2858 - RNA, 1290 nt, synthetic construct
  misc_feature 1..1290: note = derived and/or modified CDS sequence (wt) from SEOV(Gou3)__AB027522.1__N
  source 1..1290: mol_type = other RNA
atggcaactatggaagagatccagagggaaatcagtgcacacgaggggcagcttgtgatagcacgacaaaaggtcaaggatgcagaaaagcagtacgaaaaggatcctgatgatctaaacaagagggcactgcatgaccgggaaagtgtggcagcttcaatccaatcaaagattgatgagttgaagcgccagcttgccgataggattgcagcagggaagaacatcgggcaggatcgggatcctacgggagtagagccaggtgaccacctcaaagagagatcagcactaagctatgggaatacactggatctgaacagccttgacattgatgagccaacaggacagacagctgattggttgactataattgtttacctaacatcattcgttgtcccaatcatcttgaaggcactttatatgttaacaacaagaggccggcagacttcaaaagacaacaaagggatgagaattagatttaaagatgacagctcatatgaagatgttaacgggattcggaaaccaaagcatttgtatgtgtcaatgcctaatgcccaatctagcatgaaggctgaagagatcacacctgggagcttccgcactgcagtttgtgggctatatcctgcaacaataaaagcaaggaatatggtgagtcctgttatgagtgtagttgggttcctggcactggcaaaggattggacatcaaggattgaagattggctcggggccccatgcaagtttatggctgagtctcccattgccgggagcttatccgggaatcctgtaaaccgtgattacatccgacaaaggcaaggtgcactggcagggatggagcctaaagagtttcaagccctcaggcagcattcaaaagatgccggttgtacaatggtggaacaaatcgaatcaccatcatcgatatgggtgtttgccggggcccctgatcggtgcccaccaacatgtttgtttgttgggggaatggctgagctaggtgccttcttctccatacttcaagacatgaggaacacaattatggcttctaagactgtgggcactgctgatgagaagctgcgaaagaaatcatcattctaccaatcttacctccggcgcacacaatcaatgggaattcaactggatcagagaataattgttatgttcatggttgcctggggcaaagaggcagtagataactttcatcttggtgatgatatggatccagagcttcgtagcctggctcagatcctgattgatcaaaaggtgaaggagatatcaaaccaggagcccatgaagttataa

SEQ ID NO: 2859 - RNA, 1290 nt, synthetic construct
  misc_feature 1..1290: note = derived and/or modified CDS sequence (wt) from SEOV(Hb8610)__AF288643.1__N
  source 1..1290: mol_type = other RNA
atggcgactatggaagaaatccagagagaaatcagtgctcacgaggggcagcttgtgatagcacgccagaaagtcaaggatgcagaaaagcagtatgaaaaggatcctgatgacttaaacaagagggcactgcatgatcgggagagtgtcgcagcttcaatacaatcaaaaattgatgaattgaagcgccaacttgccgacaggattgcagcagggaagagcattgggcaagaccgggatcctacaggggtagagccgggtgatcatctcaaagaaagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcagacttcaaaggacaacaaagggatgaggatcagattcaaggatgacagctcatatgaggatgtcaatggaatcagaaagcccaaacatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtagttgggtttttggcactggcaaaagattggacatctagaattgaagaatggcttggtgcaccctgcaagttcatggcggaatctccaattgctgggagtttatctgggaatcccgtgaatcgtgactatatcagacagagacaaggtgcacttgcagggatggagccaaaggaatttcaagccctcaggcaacatgcaaaggatgctgggtgtacactggttgagcatattgagtcaccatcatcaatatgggtgtttgctggggcccctgataggtgtccaccaacatgtttgtttgtcggagggatggctgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaagaaggcagtggacaactttcatctcggtgatgacatggacccagagcttcgtagcctggctcagatcctgattgaccagaaagtaaaagaaatctcgaaccaggaacctatgaaattataa

SEQ ID NO: 2860 - RNA, 1290 nt, synthetic construct
  misc_feature 1..1290: note = derived and/or modified CDS sequence (wt) from SEOV(HuBJ16)__GQ279380.1__N
  source 1..1290: mol_type = other RNA
atggcaactatggaagaaatccagagagaaatcagtgctcacgaggggcagcttgtgatagcacgccagaaggtcaagaatgcagaaaaacagtatgagaaggatcctgatgacttaaataagagggcactgcatgatcgggagagtgttgcagcttcaatacaatcaaaaattgatgaattgaagcgccaacttgccgacaggattgcagcaggaaaaaacatcgggcaagaccgggatcctacaggggtagagccgggtgatcatctcaaggaaagatcagcactaagctatgggaatacactggacttgaatagtcttgacattgatgaacctacaggacagacagctgattggttgaccataattgtctatctgacatcattcgtggtcccgatcattttgaaggcactgtacatgttaacaacaagaggtaggcagacttcaaaggacaacaaggggatgaggatcagattcaaggatgacagctcatatgaggatgtcaatgggatcagaaagcccaaacatctgtatgtgtcaatgccaaacgcccaatccagcatgaaagctgaagagataacacctggaagattccgtacggcagtttgtgggctatatcctgcacagataaaggcaagaaacatggtaagccctgtcatgagtgttgttgggtttttggcactggcaaaagactggacatctagaattgaagaatggcttggcgcaccttgtaagttcatggcggagtctcccattgccgggagtttatctgggactcctgtgaatcgtgactatatcagacagagacaaggtgcacttgcaggaatggagccaaaggaatttcaagcccttaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgcattcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatggatccagagcttcgtagcctggctcagatcctgattgaccagaaagtgaaggaaatctctaaccaggaacctatgaaactataa

SEQ ID NO: 2861 - RNA, 1290 nt, synthetic construct
  misc_feature 1..1290: note = derived and/or modified CDS sequence (wt) from SEOV(HuBJ22)__GQ279379.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgttgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaacaaggggatgaggatcagattcaaggatgacagctcatatgaggatgtcaatgggatcagaaaacccaaacatctgtatgtgtcaatgccaaacgcccaatccagcatgaaagctgaagagataacacctggaagattccgtacggcagtatgtgggctatatcctgcacagataaaggcaagaaacatggtaagccctgtcatgagtgttgttgggtttttggcactggcaaaagactggacatctagaattgaagaatggcttggcgcaccttgcaagttcatggcggagtctcccattgccgggagtttatctgggactcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggatccagagcttcgtagcctggctcagatcctgattgaccagaaagtgaaggaaatctcaaaccaggaacctatgaaattataa

SEQ ID NO: 2862 - RNA, 1290 nt, synthetic construct
  misc_feature 1..1290: note = derived and/or modified CDS sequence (wt) from SEOV(HuBJ3)__GQ279391.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgttgcagcttcaatacaatcaaaaattgatgaattgaagcgccaacttgccgacaggattgcggcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccaatcatcttgaaggcactgtacatgttaacaacaagaggtaggcagacttcaaaggtcaacaaggggatgaggatcagattcaaggatgacagctcatatgaggatgtcaatggaatcagaaagcccaaacatctgtatgtgtcaatgccaaatgcccaatcaagcatgaaagctgaagagataacacctggaagattccgcacggcagtatgtgggttatatcctgcacagataaaggcaaggaacatggtaagccctgtcatgagtgtagttgggtttttggcactggcaaaagactggacatctagaattgaagaatggcttggcgcaccctgcaggttcatggcagagtctcccattgccgggagtttatctgggaatcctgtaaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccccgaggggtgtccaccaacatgcttgtttgtcggagggatggctgaattaggtgccttcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatggatcccgagcttcgtagcctggctcagatcctgattgaccagaaagtgaaggaaatctctaaccaggaacctatgaaactataa

SEQ ID NO: 2863 - RNA, 1290 nt, synthetic construct
  misc_feature 1..1290: note = derived and/or modified CDS sequence (wt) from SEOV(K24-e7)__AF288653.1__N
  source 1..1290: mol_type = other RNA
atggcaactatggaagaaatccagagagaaatcagtgctcacgaggggcagcttgtgatagcacgccagaaagtcaaggatgcagaaaagcagtatgaaaaggatcctgatgacttcaacaagagggcactgcatgatcgggagagtgtcgcagcttcaatacaatcaaaaattgatgaattgaagcgccaacttgccgacaggattgcagcagggaagaatattgggcaagaccgggatcctacaggggtagagccgggtgatcatctcaaagaaagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcagacttcaaaggacaacaaagggatgaggatcagattcaaggatgacagctcatatgaggatgtcaatggaatcagaaagcccaaacatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtggttgggtttttagcactggcaaaagattggacatctagaattgaagaatggcttggtgcaccctgcaagttcatggcggaatctccaattgctgggagtttatctgggaatcccgtgaatcgtgactatatcagacagagacaaggtgcacttgcagggatggagccaaaggaatttcaagccctcaggcaacatgcaaaggatgctgggtgtacactggttgagcatattgagtcaccatcatcaatatgggtgtttgctggggcccctgataggtgtccaccaacatgtttgttcgtcggagggatggctgagttaggtgccttcttttctatacttcaggatatgaggaacacaatcatggcttcaaaaactgtgggcacagctgatgaaaagcttcgaaagaaatcatcattctatcaatcatacctcagacgcacacaatcaatgggaattcaactggaccagaggataattgttatgtttatggttgcctggggaaaggaggcagtggacaactttcatctcggtgatgacatggacccagagcttcgtagcctggctcagatcctgattgaccagaaagtaaaagaaatctcgaaccaggaacctatgaaattataa

SEQ ID NO: 2864 - RNA, 1290 nt, synthetic construct
  misc_feature 1..1290: note = derived and/or modified CDS sequence (wt) from SEOV(K24-v2)__AF288655.1__N
  source 1..1290: mol_type = other RNA
atggcaactatggaagaaatccagagagaaatcagtgctcacgaggggcagcttgtgatagcacgccagaaagtcaaggatgcagaaaagcagtatgaaaaggatcctgatgacttcaacaagagggcactgcatgatcgggagagtgtcgcagcttcaatacaatcaaaaattgatgaattgaagcgccaacttgccgacaggattgcagcagggaagaatattgggcaagaccgggatcctacaggggtagagccgggtgatcatctcaaagaaagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcagacttcaaaggacaacaaagggatgaggatcagattcaaggatgacagctcatatgaggatgtcaatggaatcagaaagcccaaacatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtggttgggtttttagcactggcaaaagattggacatctagaattgaagaatggcttggtgcaccctgcaagttcatggcggaatctccaattgctgggagtttatctgggaatcccgtgaatcgtgactatatcagacagagacaaggtgcacttgcagggatggagccaaaggaatttcaagccctcaggcaacatgcaaaggatgctgggtgtacactggttgagcatattgagtcaccatcatcaatatgggtgtttgctggggcccctgataggtgtccaccaacatgtttgtttgtcggagggatggctgagttaggtgccttcttttctatacttcaggatatgaggaacacaatcatggcttcaaaaactgtgggcacagctgatgaaaagcttcgaaagaaatcatcattctatcaatcatacctcagacacacacaatcaatgggaattcaactggaccagaggataattgttatgtttatggttgcctggggaaaggaggcagtggacaactttcatctcggtgatgacatggacccagagcttcgtagcctggctcagatcctgattgaccagaaagtaaaagaaatctcgaaccaggaacctatgaaattataa

SEQ ID NO: 2865 - RNA, 1290 nt, synthetic construct
  misc_feature 1..1290: note = derived and/or modified CDS sequence (wt) from SEOV(OuhaiRf35)__FJ803208.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcacctcaaggaaagatcagcactaagctatgggaatacactggacctaaatagtcttgacattgatgaacctacaggacagacagctgattggttgaccataattgtctatctgacatcattcgtggtcccgatcatcttgaaggcactgtacatgttaacaacaagaggtaggcagacttcaaaggacaacaaggggatgaggattagattcaaggatgacagctcatatgaggatgtcaatggaatcagaaagcccaaacatctgtatgtgtcaatgccaaacgcccaatccagcatgaaagctgaagagataacacctggaagattccgcacagcagtgtgtgggttatatcctgcacagataaaggcaagaaacatggtaagccctgtcatgagtgtagttgggtttttggcactggcaaaagactggacatctagaattgaagaatggcttggcgcaccctgcaagttcatggcagagtctcccattgccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccgtgataggtgtccaccaacatgcttgtttgtcggagggatggctgagttaggtgccttcttttctatccttcaggacatgaggaacacaatcatggcttcaaaaactgtgggcacagctgatgaaaagctccgaaagaaatcatcattctatcaatcatacctcagacgcacacaatcaatgggaatacaactggaccagaggataattgttatgtttatggttgcctggggaaaggaagcagtggacaactttcatctcggcgatgacatggatccagagcttcgtagcctggctcagatcctgattgaccagaaagtgaaggaaatctcaaaccaggaacctatgaaattataa

SEQ ID NO: 2866 - RNA, 1290 nt, synthetic construct
  misc_feature 1..1290: note = derived and/or modified CDS sequence (wt) from SEOV(OuhaiRn146)__FJ803210.1__N
  source 1..1290: mol_type = other RNA
atggcaactatggaagaaatccagagagaaatcagtgctcacgaggggcagcttgtgatagcacgccagaaggttaaggatgcagaaaagcagtatgagaaggatcctgatgacttaaacaagagggcactgcatgatcgggaaagtgtcgcagcttcaatacaatcaaaaattgatgaattgaagcgccaacttgccgacaggattgcagcagggaaaaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccgatcattttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaacgcccaatccagcatgaaagctgaagagataacacctggaagattccgcacagcagtgtgtgggttatatcctgcacagataaaggcaagaaacatggtaagccctgtcatgagtgtagttgggtttttggcactggcaaaagactggacatctagaattgaagaatggcttggcgcaccctgcaagttcatggcagagtctcccattgccgggagtttatctgggaatcctgtgaatcgtgactatatcagacagggacaaggtgcacttgcaggaatggagccaaaggaatttcaagccctcaggcaacatgcaaaggatgctggatgtacactggttgaacatattgagtcaccatcgtcaatatgggtgtttgctggggcccgtgataggtgtccaccaacatgcttgtttgtcggaggtatggctgagttaggtgccttcttttctatccttcaggatatgaggaacacaatcatggcttcaaaaactgtgggcacggctgatgaaaagcttcgaaagaaatcatcattctatcaatcatacctcagacgcacacaatcaatgggaatacaactggaccagaggataattgttatgtttatggttgcctggggaaaggaggcagtggataactttcatctcggtgatgacatggatccagagcttcgtagcctggcccagatcctgattgaccagaaagtgaaggaaatctcaaaccaggaacctatgaaattataa

SEQ ID NO: 2867 - RNA, 1290 nt, synthetic construct
  misc_feature 1..1290: note = derived and/or modified CDS sequence (wt) from SEOV(Pf26)__AY006465.1__N
  source 1..1290: mol_type = other RNA
atggcaactatggaagaaatccagagagaaatcagtgctcacgaggggcagcttgtgatagcacgccagaaggttaaggatgcagaaaagcagtatgagaaggatcctgatgacttaaacaagagagcactgcatgatcgggagagtgttgcagcttcagtacaatcaaaaattgatgaattgaagcgccaacttgccgacaggattgcagcagggaagaacatcgggcaagaccgggatcctacaggggtagagcctggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaacaagggaatgaggatcagattcaaggatgacagctcatatgaggatgttaacggaattagaaagcccaaacatctgtatgtgtcaatgccaaacgcccaatccagcatgaaagctgaagagataacacctggaagattccgcacggcagtatgtgggctatatcctgcacagataaagccaaggaacatggtaagccctgtcataagtgtagttgggtttttggcactggcaaaagactggacatctagaattgaagaatggcttggcgcaccctgcaagttcatggcggagtctcccattgccgggagtttatctgggaatcctgtgaatcgtgactatattagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgccttcttttctatccttcaggatatgaggaacacaattatggcttctaagactgtgggcacagctgatgaaaagcttcgaaagaaatcatcattctatcaatcatacctcagacgcacacaatcaatggggatacaactggaccagaggataattgttatgtttatggttgcctggggaaaggaggcagtggacaactttcatctcggtgatgacatggatccagagcttcgtagcctggctcagatcctgattgaccagaaagtgaaggaaatctcaaaccaggaacctatgaaattataa

SEQ ID NO: 2868 - RNA, 1290 nt, synthetic construct
  misc_feature 1..1290: note = derived and/or modified CDS sequence (wt) from SEOV(Rn-CP7)__GQ279382.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgttgcagcttcaatacaatcaaaaattgatgaattgaagcgccaacttgccgacaggattgcagcagggaagaacatcgggcaagaccgggatcctacaggggtagagccgggtgatcacctcaaggaaagatcagcactaagctatgggaatacactggacctgaatagtcttgacattgatgaacctacaggacagacagctgattggttgaccataattgtctatctgacatcattcgtggtcccaatcatcttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaatgcccaatcaagcatgaaagctgaagagataacacctggaagattccgcacggcagtatgtgggttatatcctgcacagataaaggcaaggagcatggtaagccctgtcatgagtgtagttgggtttttggcactggcaaaagactggacatctagaattgaagaatggcttggcgcaccctgcaagttcatggcagagtctcccattgccgggagtttatctgggaatcctgtaaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggagggatggctgaattaggtgccttcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatggatccagagcttcgtagcctggctcagatcctgattgaccagaaagtgaaggaaatctctaaccaggaacctatgaaactataa

SEQ ID NO: 2869 - RNA, 1290 nt, synthetic construct
  misc_feature 1..1290: note = derived and/or modified CDS sequence (wt) from SEOV(Rn-DC8)__GQ279386.1__N
  source 1..1290: mol_type = other RNA
atggcaactatggaagaaatccagagagaaatcagtgctcacgaggggcagcttgtgatagcacgccagaaggttaaggatgcagaaaagcagtatgagaaggatcctgatgacttaaacaagagggcactgcatgatcgggagagtgttgcagcttcaatacaatcaaaaattgatgaattgaagcgccaacttgccgacaggattgcagcagggaagaacatcgggcaagaccgggatcctacaggggtagagccgggtgatcacctcaaggaaagatcagcactaagctatgggaatacactggacctgaatagtcttgacattgatgaacctacaggacagacagctgattggttgaccataattgtctatctgacatcattcgtggtcccgattatcttgaaggcactgtacatgttaacagcaagaggtaggcagacttcaaaggacaacaaggggatgaggatcagattcaaggatgacagctcatatgaggatgtcaatggaatcagaaagcccaaacatctgtatgtgtcaatgccaaatgcccaatcaagcatgaaagctgaagagataacacctggaagattccgcacggcagtatgtgggttatatcctgcacagataaaggcaaggagcatggtaagccctgtcatgagtgtagttgggtttttggcactggcaaaagactggacatctagaattgaagaatggcttggcgcaccctgcaagttcatggcagagtctcccattgccgggagtttatctgggaatcctgtaaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggagggatggctgaattaggtgccttcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatggatccagagcttcgtagcctggctcagatcctgattgaccagaaagtgaaggaaatctctaaccaggaacctatgaaactataa

SEQ ID NO: 2870 - RNA, 1290 nt, synthetic construct
  misc_feature 1..1290: note = derived and/or modified CDS sequence (wt) from SEOV(Rn-M11)__GQ279383.1__N
  source 1..1290: mol_type = other RNA
atggcaactatggaagaaatccagagagaaatcagtgctcacgaggggcagcttgtgatagcacgccagaaggttaagaatgcagaaaagcagtatgagaaggatcctgatgacttaaacaagagggcactgcatgatcgggagagtgttgcagcttcaatacaatcaaaaattgatgaattgaagcgccaacttgccgacaggattgcagcagggaagaacatcgggcaagaccgggatcctacaggggtagagccgggtgatcacctcaaggaaagatcagcactaagctatgggaatacactggacctgaatagtcttgacattgatgaacctacaggacagacagctgattggttgaccataattgtctatctgacatcattcgtggttccgatcatcttaaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaatgcccaatcaagcatgaaagctgaagagataacacctggaagattccgcacggcagtatgtgggttatatcctgcacagataaaggcaaggagcatggtaagccctgtcatgagtgtagttgggtttttggcactggcaaaagactggacatctagaattgaagaatggcttggcgcaccctgcaagttcatggcagagtctcccattgccgggagtttatctgggaatcctgtaaatcgtgactatatcagacagagacgaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggagggatggctgaattaggtgccttcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatggatccagagcttcgtagcctggctcagatcctgattgaccagaaagtgaaggaaatctctaaccaggaacctatgaaactataa

SEQ ID NO: 2871 - RNA, 1290 nt, synthetic construct
  misc_feature 1..1290: note = derived and/or modified CDS sequence (wt) from SEOV(RuianRf74)__FJ803213.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccaatcatcttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaacgcccaatcaagcatgaaagctgaagagataacacctggaagattccgcatggcagtatgtgggttatatcctgcacagataaaggcaaggaacatggtaagccctgtcatgagtgtagttgggtttttggcactggcaaaagactggacatctagaattgaagaatggcttggcgcaccctgcaagttcatggcagagtctcccattgccgggagtttatctgggaatccggtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatagatccagagcttcgtagcctggctcagatcctgattgaccagaaagtgaaggaaatctctaaccaggaacctatgaaactataa

SEQ ID NO: 2872 - RNA, 1290 nt, synthetic construct
  misc_feature 1..1290: note = derived and/or modified CDS sequence (wt) from SEOV(RuianRn23)__FJ803214.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccaatcatcttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaacgcccaatcaagcatgaaagctgaagagataacacctggaagattccgcacggcagtatgtgggttatatcctgcacagataaaggcaaggaacatggtaagccctgtcatgagtgtggttgggtttttggcactggcaaaagactggacatctagaattgaagaatggcttggcgcaccctgcaagttcatggcagagtctcccattgccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggagggatggctgagttaggtgccttcttttctatccttcaggacatgaggaacacaatcaaggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaagcagtggacaactttcatctcggtgatgacatggatccagagcttcgtagcctggctcagatcctgattgaccagaaagtgaaggaaatctctaaccaggaacctatgaaactataa

SEQ ID NO: 2873 - RNA, 1290 nt, synthetic construct
  misc_feature 1..1290: note = derived and/or modified CDS sequence (wt) from SEOV(RuianRn33)__FJ803215.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctgacatcattcgtggtcccaatcatcttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaacgcccaatcaagcatgaaagctgaagagataacacctggtagattccgtacggcagtatgtgggctatatcctgcacagataaaggcaagaaacatggtaagccctgtcatgagtgtagttgggtttttggcactggcaaaagactggacatctagaattgaagaatggcttggcgcaccctgcaagttcatggcagagtcacccattgccgggagtttatctgggaatcctgtgaatcgtgactatatcagacagagacaaggtgcacttgcaggaatggagccaaaggaatttcaagccctcaggcaacatgcaaaggatgctggatgtacacttgttgaacatattgagtcaccatcgtcaatatgggtgtttgctggggcccctgataggtgtccaccaacatgcttgtttgtcggagggatggctgagttaggtgccttcttttctatccttcaggacatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcccggggaaaggaagcaatgtacaacttacatctccgtgacgacatgactcctcagcttcttcttttggttcaaatcctgcttgatcaccaagtgaaggaaatctctaaccaggaacttatgaaactataa

SEQ ID NO: 2874 - RNA, 1290 nt, synthetic construct
  misc_feature 1..1290: note = derived and/or modified CDS sequence (wt) from SEOV(SC106)__GU361893.1__N
  source 1..1290: mol_type = other RNA
atggcaactatggaagaaatccagagagaaatcagtgctcacgaggggcagcttgtgatagcacgccagaaggttaaggatgcagaaaagcagtatgagaaggatcctgatgacttaaacaagagagcactgcatgatcgggagagtgtcgcagcttcaatacaatcaaaaattgatgaattgaagcgccaacttgccgacaggattgcagcagggaagaacatcgggcaagaccgggatcctacaggggtagagcctggtgatcatctcaaggaaagatcagcactaagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaacaagggaatgaggatcagattcaaggatgacagctcatatgaggatgttaacggaattagaaagcccaaacatctgtatgtgccaatgccaaacgcccaatccagcatgaaagctgaagagataacacctggaagattccgcacggcagtatgtgggctatatcctgcacagataaaggcaaggaacatggtaagccctgtcatgagtgtagttgggtttttggcactggcaaaagactggacatctagaattgaagaatggcttggcgcaccctgcaagttcatggcggagtctcccattgccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgcctttttttctatccttcaggatatgaggaacacaattatggcttctaagactgtgggcacagctgatgaaaagcttcgaaagaaatcatcattctatcaatcatacctcagacgcacacaatcaatgggaatacaactggaccagaggataattgttatgtttatggtcgcctggggaaaggaggcagtggacaactttcatctcggtgatgacatggatccagagcttcgtagtctggctcagatcctgattgaccagaaagtgaaggaaatctcaaaccaggaacctatgaaattataa

SEQ ID NO: 2875 - RNA, 1290 nt, synthetic construct
  misc_feature 1..1290: note = derived and/or modified CDS sequence (wt) from SEOV(SEO/Belgium/Rn895/2005)__JQ898106.1__N
  source 1..1290: mol_type = other RNA
atggcaactatggaagaaatccagagagaaatcagtgctcacgaggggcagctcgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgtcaacttgccgacaggattgcagcaggaaagaacatcgggcaagaccgggatcctacaggggtagagccgggtgatcatctcaaggaaagatcagcactaagctatgggaatacactggacttgaatagtcttgacattgatgaacctacaggacagacagctgactggttgaccataattgtctatctgacatcattcgtggtcccgatcatcttgaaggcattgtacatgttaacaacaagaggtaggcagacttcaaaggacaataaggggatgagaatcaggttcaaggatgacagctcatatgaggatgtcaatggaatcaggaagcccaaacatttgtatgtgtcaatgccaaacgcccagtccagcatgaaggctgaagagataacacctggaagattccgcactgcagtatgtgggctatatcctgcacagataaaggcaaggaacatggtaagccctgtcatgagtgtagttgggtttttggcactggcaaaagactggacatctagaattgaagaatggcttggtgcaccctgcaagttcatggcggattctcccattgccgggagtttatctgggaatcctgtgaatcgtgactacatcagacagagacaaggtgcacttgcaggaatggagccaaaggaatttcaagccctcaggcaacattcaaaggatgctggatgtacactggttgaacatattgagtcaccatcatcaatatgggtgtttgctggggcccctgataggtgtccaccaacatgtttgtttgtcggagggatggctgagttaggtgccttcttttccatacttcaggatatgaggaacacaatcatggcttctaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgatatggatccagagcttcgtagcctggctcagatcctgattgaccagaaagtgaaggaaatctcgaaccaggaacctatgaaattataa

SEQ ID NO: 2876 - RNA, 1290 nt, synthetic construct
  misc_feature 1..1290: note = derived and/or modified CDS sequence (wt) from SEOV(Taonan420)__KF745951.1__N
  source 1..1290: mol_type = other RNA
atggcaactatggaagaaatccagagagaaatcagtgctcacgaggggcagcttgtgatagcacgccagaatgttaaggatgcagaaaagcagtatgagaaggatcctgatgacttaaacaagagagcactgcatgatcgggagagtgtcgcagcttcaatacaatcaaaaattgatgaattgaagcgccaacctgccgacaggattgcagcagggaagaacatcgggcaagaccgggatcctacaggggtagagcctggtgatcatctcaaggaaagatcagcactaagctatgggaatacactggacctgaatcgtcttgacattgatgaacctacaggacagagagctgattggttgaccataattgtctatctgacatcattcgtggtccggatcatcttgaaggcactgtacatgttttcaacaagaggtaggcagacttcaaaggacaacaagggactgaggatcagattcaaggatgacagctcatatgaggattttaacggaattagaaagcccaaacatctgtatgtgccaatgccaaacgcccaatccagcatgaaagctgaagagataacacctggaagattccgcacggcagtatgtgggctatatcctgcacagataaaggcaaggaacatggtaagccctgtcatgagtgtagttgggtttttggcactggcaaaagactggacatctagaattgaagaatggcttggcgcaccctgcaagttcatggcggagtctcccattgccgggagtttatctgggaatcctgtgaatcgtgactatatcagacagagacaaggtgcacttgcagcaatggagccaaaggaatttcaagccctcaggcaacatgcaaaggatcctggatgtacactggttgaacatattgagtcaccatcgtcaatatgggtgtctgctggggcccctgataggtgtccaccaacatgcttgtttgtcggagggatggctgagttaggtgcctttttttctatttttcaggatatgaggaacacaattatgccttctaagactgtgggcacagctgatgaaaagcttcgaaagaaatcattattctatcaatcatacctcagacgcacacaatcaatgggaatacaactggaccagaggataattgttatgtttatggtcgcctggggaaaggaggcagtggacaactttcatctccctgatgacatggatccagagcttcgtagtctggctcagatcctgattgtccagaaagtgaaggaaatctcaaaccaggaacctatgaaattataa

SEQ ID NO: 2877 - RNA, 1290 nt, synthetic construct
  misc_feature 1..1290: note = derived and/or modified CDS sequence (wt) from SEOV(Taonan52)__KF745950.1__N
  source 1..1290: mol_type = other RNA
atggcaactatggaagaaatccagagagaaatcagtgctcacgaggggcagcttgtgacagcacgccagaaggttaaggatgcagaaaagcagtatgagaaggatcctgatgacttaaacaagagagcactgcatgatcgggagagtgtcgcagcttcaatacaatcgaaaattgatgaagtcaagcgccaacttgccgacaggattgcagcagggaagaacatcgggcaagaccgggatcctacaggggtagagcctggtgatcatcccaaggaaagatcagcactaagctatgggaatacactggacctgaacagtcttgacattgatgaacctacaggacagacagctgattggttgaccataattgtctatctgacatcattcgtggtcccgatcatcttgaaggcactgtacatgtcaacaacaagaggtaggcagacttcaaaggacaacaggggaatgaggatcagattccaggatgacagctcatatgaggatgttaacggaattagaaagcccaaacatctgtatgtgccaatgccaaacgcccaatccagcatgaaagctgaagaggtaacacctggaagattccgcacggcagtatgtgggctatatcctgcacagataaaggcaaggaacatggtaaggcctgtcatgagtgtagttgggtttttggcactggcaaaagcctggacatctagaattgaagaatggcttggcgcaccctgcaagttcatggcggagtctcccattgccgggagtttatctgggaatcctgtgtatcgtgactatatcagacagagacaaggagcacttgcaggaatggagccaaaggaatttcaagccctcaggcaacatgcaaaggatgctggatgtacactggttgaacttattgagtcaccatcgtcaatatcggtgtttgctggggcccctgataggtgtccacgaacatgcttgtttgtcggagggatggctgagttaggtgccaatttttctatgcttcaggatatgagcaacacaattatggcttctaagactgtgggcacagctgatgaaaagcttcgaaagaaatcatcattctatcaatcatacctcagacgcacacaatcaatgggaatacaactggaccagaggataattgttatgtttatggtcgcctctggaaaggaggcagtggactactttcatctcggtgatgacatggatccagagcttcgtagtctggctccgatcctgattgaccagaaagtgaaggaaatctcaaaccaggaacctatgaaattataa

SEQ ID NO: 2878 - RNA, 1290 nt, synthetic construct
  misc_feature 1..1290: note = derived and/or modified CDS sequence (wt) from SEOV(WuhanMm24)__JQ665911.1__N
  source 1..1290: mol_type = other RNA
atggcaactatggaagaaatccagagagaaatcagtgctcacgaggggcagcttgtgatagcacgccagaaggtcaaggatgcagaaaaacagtatgagaaggatcctgatgatttaaataagagggcactgcatgatcgggagagtgccgcagcttcaatacaatcaaaaattgatgaattgaagcgccaacttgccgacaggattgcagcagggaagaacatcgggcaagaccgggatcctacaggggtagagccgggcgatcatctcaaggaaagatcagcattaagctatgggaatacactggacctgaatagtcttgacattgatgaacctacaggacagacagctgattggttgaccataattgtctatctgacatcattcgtggtcccgatcatattgaaggcactgtatatgttaacaacaagaggtaggcagacctcaaaggacaacaaggggatgaggatcaggttcaaggatgacagctcatatgaggatgtcaatggaatcagaaagcccaaacatctgtatgtgtcaatgccaaatgcccaatctagcatgaaggctgaagagataacacctggaagattccgcactgcagtatgtgggctatatcctgcacagataaaggcaaggaacatggtaagtcctgtcatgagtgtagttgggtttttggcactggcaaaagactggacatctagaattgaagaatggcttggcgcaccctgcaagttcatggcggagtctcccattgccgggagtttatctgggaatcctgtgaatcgtgactatatcagacagagacaaggtgcacttgcagggatggagccaaaggaatttcaagccctcaggcaacattcaaaggatgctggatgtacactggttgaacatattgagtcaccatcgtcaatatgggtgtttgctggggcccctgacaggtgtccaccaacatgcttgtttgtcggagggatggctgggttgggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatcttggtgatgacatggatccagagcttcgtagcctggctcagatcctgattgaccagaaagtgaaggaaatctcaaaccaggaacctatgaaattataa

SEQ ID NO: 2879 - RNA, 1290 nt, synthetic construct
  misc_feature 1..1290: note = derived and/or modified CDS sequence (wt) from SEOV(WuhanRf02)__JQ665912.1__N
  source 1..1290: mol_type = other RNA
atggcaactatggaagaaatccagagagaaatcagtgctcacgaggggcagcttgtgatagcacgccagaaggtcaaggatgcagaaaaacagtatgagaaggatcctgatgatttaaataagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggcgatcatctcgaggaaaggtcagcattaagctatgggaatacactggacctgaatagtcttgacattgatgaacctacaggacagacagctgattggttgaccataattgtctacctgacatcattcgtggtcccgatcatattgaaggcactgtatatgttaacaacaagaggtaggcagacctcaaaggacaacaaggggatgaggatcaggttcaaggatgacagctcatatgaggatgtcaatggaatcagaaagcccaaacatctgtatgtgtcaatgccaaatgcccaatctagcatgaaggctgaagagataacacctggaagattccgcactgcagtatgtgggctatatcctgcacagataaaggcaagggacatggtaagtcctgtcatgagtgtagttgggtttttggcactggcaaaagactggacatctagaattgaagaatggcttggcgcaccctgcaagttcatggcggagtctcccattgccgggagcctatctgggaatcctgtgaatcgtgactatatcagacagagacaaggtgcacttgcagggatggagccaaaggaatttcaagccctcaggcaacattcaaaggatgctggatgtacactggttgaacatattgagtcaccatcgtcaatatgggtgtttgctggggcccgtgataggtgtccaccaacatgcttgtttgtcggagggatggctgagttgggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatcttggtgatgacatggatccagagcttcgtagcctggctcagatcctgattgaccagaaagtgaaggaaatctcaaaccaggaacctatgaaattataa

SEQ ID NO: 2880 - RNA, 1290 nt, synthetic construct
  misc_feature 1..1290: note = derived and/or modified CDS sequence (wt) from SEOV(WuhanRf07)__JQ665913.1__N
  source 1..1290: mol_type = other RNA
atggcaactatggaagaaatccagagagaaatcagtgctcacgaggggcagcttgtgatagcacgccagaaggtcaaggatgcagaaaaacagtatgagaaggatcctgatgatttaaataagagggcactgcatgatcgagagagtgtcgcagcttcaatacaatcaaaaattgatgaattgaagcgccaacttgccgacaggattgcagcagggaagaacatcgggcaagaccgggatcctacaggggtagagccgggcgatcatctcaaggaaagatcagcattaagctatgggaatacacttgacctgaatagtcttgacattgatgaacctacaggacagacagctgattggttgaccataattgtctatctgacatcattcgtggtcccgatcatattgaaggcactgtatatgttaacaacaagaggtaggcagacctcaaaggacaacaaggggatgaggatcaggttcaaggatgacagctcatatgaggatgtcaatggaatcagaaagcccaaacatctgtatgtgtcaatgccaaatgcccaatctagcatgaaggctgaagagataacacctggaagattccgcactgcagtatgtgggctatatcctgcacagataaaggcaaggaacatggtaagtcctgtcatgagtgtagttgggtttttggcactggcaaaagactggacatctagaattgaagaatggcttggcgcaccctgcaagttcatggcggagtctcccattgccgggagtttatctgggaatcctgtgaatcgtgactatatcagacagagacaaggtgcacttgcagggatggagccaaaggaatttcaagccctcaggcaacattcaaaggatgctggatgtacactggttgaacatattgagtcaccatcgtcaatatgggtgtttgctggggcccgtgataggtgtccaccaacatgcttgtttgtcggagggatggctgagttgggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatcttggtgatgacatggatccagagcttcgtagcctggctcagatcctgattgaccagaaagtgaaggaaatctcaaaccaggaacctatgaaattataa

SEQ ID NO: 2881 - RNA, 1290 nt, synthetic construct
  misc_feature 1..1290: note = derived and/or modified CDS sequence (wt) from SEOV(ZJ5)__FJ753400.1__N
  source 1..1290: mol_type = other RNA
atggcaactatggaagaaatccagagggaaatcagtgcacacgaggggcagcttgtgatagcacgccaaaaggtcaaggatgcagaaaagcagtatgaaaaggatcctgatgatctaaacaagagggcgctgcatgaccgggaaagtgtggcagcttcaatacaatcaaaaatagatgaattgaagcgccagcttgctgataggattgcagcagggaagaacatcgggcaagacagggatcctacaggggtagaaccaggtgaccacctcaaagagagatcagcattaagctacgggaatacactggatttgaatagtcttgatattgatgagccaacaggacagacagctgattggttgactataattgtttacctgacatcatttgttgtcccaatcatcttgaaggcactttatatgttaacaacaagaggccggcagacttcaaaagacaacaaggggatgagaatcagatttaaagatgacagctcatatgaagatgtcaacgggattcggaaaccaaagcatttgtatgtgtcaatgcccaatgcccaatccagcatgaaggctgaagagatcacacctgggaggttccgcactgctgtttgtgggctataccctgcccaaataaaagcaaggaatatggtaagtcctgttatgagtgtggttgggttcctggcactggcaaaggattggacatcaaggatcgaagagtggcttggggccccatgcaagttcatggctgagtctcccattgccgggagtctatctggaaatcttgtaaatcgtgattacatccgacagaggcagggtgcacttgcagggatggagcctaaagagtttcaggccctcaggcaacattcaaaagatgctggttgcacactggtggaacatattgaatcaccatcatcaatatgggtgtttgccggggctccagatcggtgcccaccaacatgtttgttcgttggtgggatggctgagctaggtgccttcttctccatactccaggatatgagaaatacgattatggcttctaagactgtgggcactgctgatgagaagctacgaaaaaaatcatcattctaccagtcttacctccggcgcacacaatcaatgggaattcaactggatcagagaataattgttatgttcatagttgcctgggggaaagaggcagtagataactttcatcttggtgatgatttggatccagagcttcgtagccttgctcagatcctgattgatcaaaaggtgaaggaaatatcaaaccaagagcccatgaaattataa

SEQ ID NO: 2882 - RNA, 1290 nt, synthetic construct
  misc_feature 1..1290: note = derived and/or modified CDS sequence (wt) from SEOV(ZT10)__AY766368.1__N
  source 1..1290: mol_type = other RNA
atggcactatgtgaagaaatccagagagaaatcagtgctcacgaggggcagcttgtgatagcacgccagaaggtcaaggatgcagaaaagcagtatgagaaggatcctgatgactttaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctaacatcatttgtggtcccgatcatcttgaaggcactgtacatgttaacaacaagaggtaggcagacttcaaaggacaacaaggggatgaggattagattcaaggatgacagctcatatgaggatgtcaatggaatcagaaagcccaaacatctgtatgtgtcaatgccaaatgcccaatccagcatgaaagctgaagagataacacctggaagattccgcacagcagtatgcgggctatatcctgcacagataaaggcaaggaacatggtaagccctgtcatgagtgtagttgggtttttggcactggcaaaagactggacatctagaattgaagaatggcttggcgcaccttgcaagttcatggcggaatctcccattgccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgacaggtgtccaccaacatgcttgtttgtcggagggatggctgagttaggtgccttcttttctggccttgcggatatgaggaacacaatcatggcttcaaaaactgagggcacagctgatgaaaagcttcgaaagaaatcatcattctatcaatcatacctcagacgccaacaatcaatggggatacaactggaccagaggataattgttatgtttatggttgcctggggaaaggaggcagtggacaactttcatcttggtgatgacatggacccagagcttcgtagcctggctcagatcctgattgaccagaaagtgaaggaaatctcaaaccaggaacctatgaaattataa

SEQ ID NO: 2883 - RNA, 1290 nt, synthetic construct
  misc_feature 1..1290: note = derived and/or modified CDS sequence (wt) from SEOV(ZT71)__AY750171.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgactttaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctaacatcatttgtggtcccgatcatcttgaaggcactgtacatgttaacaacaagaggtaggcagacttcaaaggacaacaaggggatgaggattagattcaaggatgacagctcatatgaggatgtcaatggaatcagaaagcccaaacatctgtatgtgtcaatgccaaatgcccaatccagcatgaaagctgaagagataacacctggaagattccgcacagcagtatgcgggctatatcctgcacagataaaggcaaggaacatggtaagccctgtcatgagtgtagttgggtttttggcactggcaaaagactggacatctagaattgaagaatggcttggcgcaccttgcaagttcatggcggaatctcccattgccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgacaggtgtccaccaacatgcttgtttgtcggagggatggctgagttaggtgccttcttttctatccttcaggatatgaggaacacaatcatggcttcaaaaactgagggcacagctgatgaaaagcttcgaaagaaatcatcattctatcaatcatacctcagacgccaacaatcaatggggatacaactggaccagaggataattgttatgtttatggttgcctggggaaaggaggcagtggacaactttcatcttggtgatgacatggacccagagcttcgtagcctggctcagatcctgattgaccagaaagtgaaggaaatctcaaaccaggaacctatgaaattataa

SEQ ID NO: 2884 - RNA, 1290 nt, synthetic construct
  misc_feature 1..1290: note = derived and/or modified CDS sequence (wt) from SEOV(zy27)__AF406965.1__N
  source 1..1290: mol_type = other RNA
atggcaactatggaagaaatccagagagaaatcagtgctcacgaggggcagctcgtgatagcacgccagaaggttaaggatgcagaaaagcagtatgagaaggatcctgatgactcaaacaagagagcactgcatgatcgggagagtgttgcagcttcaatacaatcaaaaattgatgaattgaagcgccaacttgccgacaggattgcagcagggaagaacatcgggcaagaccgggatcctacaggggtagagcctggtgatcatctcaaggaaagatcagcaccaagctatgggaatacactggacctgaatagtcttgacattgatgaacctacaggacagacagctgattggttgaccataattgtctatctgacatcattcgtggtcccgatcatcttgaaggcactgtacatgttaacaacaagaggtaggcagacttcaaaggacaacaagggaatgaggatcagattcaaggatgacagctcatatgaggatgttaacggaattagaaagcccaaacatctgtatgtgtcaatgccaaacgcccaatccagcatgaaagctgaagagataacacctgaaagattccgcacggcagtatgtgggctatatcctgcacagataaaggcaaggaacatggtaagccctgtcatgagtgtagttgggtttttggcactggcaaaagactggacatctagaattgaagaatggcttggcgcaccctgcaagttcatggcggagtctcccattgccgggagtttatctgggaatcctgtgaatcgtgaccatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgataggtgtccaccaacatgcttgtttgtcggaggtatggctgagttaggtgccttcttttctatccttcaggatatgaggaacacaattatggcttctaagactgtgggcacagctgatgaaaagcttcgaaagaaatcatcattctatcaatcatacctcagacgcacacaatcaatggggatacaactggaccagaggataattgttatgtttatggttgcctggggaaaggaggcagtggacaactttcatctcggtgatgacatggatccagagcttcgtagcctggctcaaatcctgattgaccagaaagtgaaggaaatctcaaaccaggaacctatgaaattataa

SEQ ID NO: 2885 - RNA, 1290 nt, synthetic construct
  misc_feature 1..1290: note = derived and/or modified CDS sequence (wt) from SEOV(DN2)__KX289954.1__N
  source 1..1290: mol_type = other RNA
atggcaactatggaagaaatccagagagaaatcagtgctcacgaggggcagcttgtgatagcacgccagaaggccaaggatgcagaaaagcagtatgagaaggatcctgatgacttaaacaagagggcactgcatgatcggggaagtgtcgcagcttcaatacaatcaaaaattgatgaattaaagcgccaacttgccgacaggattgcagcagggaagaacatcgggcaagaccgggatcctacaggggtagagccaggtgatcatctcaaggaaagatcagcactaagctatgggaatacactggacttaaatagtcttgacattgatgaacctacaggacagacagctgattggttgaccataattgtctatctgacatcattcgtggtcccgatcatcctgaaggcactgtacatgttaacaacaagaggtaggcagacttcaaaggacaacaaggggatgagaatcaggttcaaggatgacagctcatatgaggatgtcaatggaatcagaaagcccaaacatttgtatgtgtcaatgccaaacgcccaatccagcatgaaggctgaagagataacacctggaagattccgcactgcagtatgtgggctatatcctgcacagataaaggcaaggaacatggtaagccctgtcatgagtgtagttgggtttttggcactggcaaaggactggacatctagaattgaagaatggcttggcgaaccctgcaagttcatggcggagtctcccattgccgggagtttatctgggaatcctgtaaatcgtgactatatcagacagagacaaggtgcacttgcagggatggagccaaaggaatttcaagccctcaggcaacattcaaaggatgctggatgtacactggttgaacatattgagtcaccatcatcaatatgggtgtttgctggggcccctgacaggtgcccaccaacatgtttgtttgtcggagggatggctgagttaggtgtcttcttttccatacttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggataactttcatctcggtgatgacatggatccagagcttcgtagcctggctcagatcctgattgatcaaaaagtgaaggaaatctcgaaccaggaacctatgaaattataa

SEQ ID NO: 2886 - RNA, 1290 nt, synthetic construct
  misc_feature 1..1290: note = derived and/or modified CDS sequence (wt) from SEOV(IR162)__KX079476.1__N
  source 1..1290: mol_type = other RNA
atggcaactatggaagaaatccagagagaaatcagtgctcacgaggggcagcttgtgatagcacgccagaaggtcaaggatgcagaaaaacaatatgagaaggatcctgatgacttaaataagagggcactgcatgatcgggagagtgttgcagcttcaatacaatcaaaaatcgatgaattgaagcgccaacttgctgacaggattgcagcagggaagaacatcgggcaagaccgggatcctacaggggtagagccgggtgatcatctcaaggaaagatcagcactaagctacgggaatacactggacctgaatagtcttgacattgatgaacctacaggacagacagctgattggttgaccataattgtctatttgacatcatttgtggtcccgatcatcttgaaggcactgtacatgttaacaacaagaggcaggcagacttcaaaggacaacaaggggatgaggatcagattcaaggatgacagctcatatgaagatgtcaatggaatcagaaagcctaaacatctgtatgtgtcaatgccaaacgcccaatccagcatgaaggctgaagagataacacctggaagatttcgcactgcagtatgtgggctataccctgcacagataaaggcaaggaacatggtaagccctgtcatgagtgtagttgggtttttggcactggcaaaagactggacatctagaattgaagaatggcttgacacaccctgtaagttcatggtagagtctcccattgccgggagtttatctgggaatcctgtgaatcgtgattatatcagacagagacaaggtgcacttgcagggatggagccaaaggaatttcaagctctcaggcaacattcaaaggatgctggatgtacactggttgaacatattgagtcaccatcatcaatatgggtgtttgctggggcccctgataggtgtccaccaacatgcttgtttgtcggagggatggctgagttaggtgccttcttttctatacttcaggatatgaggaacacaatcatggcttcaaaaactgtgggcacagctgatgaaaagcttcgaaagaaatcatcattctatcaatcatacctcaggcgcacacaatcaatgggaatacaactggaccagaggataattgtcatgtttatggttgcctggggaaaggaggcagtggacaactttcatctcggtgatgacatggatccagagcttcgtagcctggctcagatcctgattgatcagaaagtgaaggaaatctcaaaccaggaacctatgaagttataa

SEQ ID NO: 2887 - RNA, 1290 nt, synthetic construct
  misc_feature 1..1290: note = derived and/or modified CDS sequence (wt) from SEOV(Gou3)__AF184988.1__N
  source 1..1290: mol_type = other RNA
atggcaactatggaagagatccagagggaaatcagtgcacacgaggggcagcttgtgatagcacgacgaaaggtcaaggatgcagaaaagcagtacgaaaaggatcctgatgatctaaacaagagggcactgcatgaccgggaaagtgtggcagcttcaatccaatcaaagattgatgagttgaagcgccagcttgccgataggattgcagcagggaagaacatcgggcaggatcgggatcctacgggagtagagccaggtgaccacctcaaagagagatcagcactaagctatgggaatacactggatctgaacagccttgacattgatgagccaacaggacagacagctgattggttgactataattgtttacctaacatcattcgttgtcccaatcatcttgaaggcactttatatgttaacaacaagaggccggcagacttcaaaagacaacaaagggatgagaattagatttaaagatgacagctcatatgaagatgttaacgggattcggaaaccaaagcatttgtatgtgtcaatgcctaatgcccaatctagcatgaaggctgaagagatcacacctgggaggttccgcactgcagtttgtgggctatatcctgcacaaataaaagcaaggaatatggtgagtcctgttatgagtgtagttgggttcctggcactggcaaaggattggacatcaaggattgaagattggctcggggccccatgcaagtttatggctgagtctcccattgccgggagcttatccgggaatcctgtaaaccgtgattacatccgacaaaggcaaggtgcactggcagggatggagcctaaagagtttcaagccctcaggcagcattcaaaagatgccggttgtacactggtggaacatatcgaatcaccatcatcgatatgggtgtttgccggggcccctgatcggtgcccaccaacatgtttgtttgttgggggaatggctgagctaggtgccttcttcttcatacttcaagacatgaggaacacaattatggcttctaagactgtgggcactgctgatgagaagctgcgaaagaaatcatcattctaccaatcttacctccggcgcacacaatcaatgggaattcaactggatcagagaataattgttatgttcatggttgcctggggcaaagaggcagtagataactttcatcttggtgatgatatggatccagagcttcgtagcctggctcagatcctgattgatcaaaaggtgaaggagatatcaaaccaggagcccatgaagttataa

SEQ ID NO: 2888 - RNA, 1290 nt, synthetic construct
  misc_feature 1..1290: note = derived and/or modified CDS sequence (wt) from SEOV(Gou3-v9)__AF288651.1__N
  source 1..1290: mol_type = other RNA
atggcaactaaggaagagatccagagggaaatcagtgcacacgaggggcagcttgtgatagcacgacaaaaggtcaaggatgcagaaaagcagtacgaaaaggatcctgatgttctaaacaagagggcactgcatgaccgggaaagtgtggcagcttcaatccaatcaaagattgatgagttgaagcgccagcttgccgataggattgcagcagggaagagcatcgggcaggatcgggatcctacgggagtagagccaggtgaccacctcaaagagagatcagcactaagctatgggaatacactggatctgaacagccttgacattgatgagccaacaggacagacagctgattggttgactataattgtttacctaacatcattcgtcgtcccaatcatcttgaaggcactttatatgttaacaacaagaggccggcagacttcaaaagacaacagagggatgagaattagatttaaagatgacagctcatatgaagatgttaacgggattcggaaaccaaagcatttgtatgtgtcaatgcctaatgcccaatctagcatgaaggctgaagagatcacacctgggaggttccgcactgcagtttgtgggctatatcctgcacaaataaaagcaaggaatatggtgagtcctgttatgagtgtagttgggttcctggcactggcaaaggattggacatcaaggattgaagattggctcggggccccatgcaagtttatggctgagtctcccattgccgggagcttatccgggaatcctgtaaaccgtgattacatccgacaaaggcaaggtgcactggcagggatggagcctaaagagtttcaagccctcaggcagcattcaaaagatgccggttgtacactggtggaacatatcgaatcaccatcatcgatatgggtgtttgccggggcccctgatcggtgcccaccaacatgtttgtttgttgggggaatggctgagctaggtgccttcttctccatacttcaagacatgaggaacacaattatggcttctaagactgtgggcactgctgatgagaagctgcgaaagaaatcatcattctaccaatcttacctccggcgcacacaatcaatgggaattcaactggatcagagaataattgttatgttcatggttgcctggggcaaagaggcagtagataactttcatcttggtgatgatatggatccagagcttcgtagcctggctcagatcctgattgatcaaaaggtgaaggagatatcaaaccaggagcccatgaagttataa

SEQ ID NO: 2889 - RNA, 1290 nt, synthetic construct
  misc_feature 1..1290: note = derived and/or modified CDS sequence (wt) from SEOV(IR461)__AF329388.1__N
  source 1..1290: mol_type = other RNA
atggcaactatggaagaaatccagagagaaatcagtgctcacgaggggcagcttgtgatagcacgccagaaggtcaaggatgcagaaaaacaatatgagaaggatcctgatgacttaaataagagggcactgcatgatcgggagagtgttgcagcttcaatacaatcaaaaatcgatgaattgaagcgccaacttgctgacaggattgcagcagggaagaacatcgggcaagaccgggatcctacaggggtagagccgggtgatcatctcaaggaaagatcagcactaagctacgggaatacactggacctgaatagtcttgacattgatgaacctacaggacagacagctgattggttgaccataattgtctatttgacgtcatttgtggtcccgatcatcttgaaggcactgtacatgttaacaacaagaggcaggcagacttcaaaggacaacaaggggataaggatcagattcaaggatgacagctcatatgaaaatgtcaatggaatcagaaagcctaaacatctgtatgtgtcaatgccaaacgcccaatccagcatgaaggctgaagagataacacctggaagatttcgcactgcagtatgtgggctataccctgcacagataaaggcagggaacatggtaagccctgtcatgagtgtagttgggtttttggcactggcaaaagactggacatctagaattgaagaatggcttgacacaccctgtaagttcatggtagagtctcccattgccgggagtttatctgggaatcctgtgaatcgtgattatatcagacagagacaaggtgcacttgcagggatggagccaaaggaatttcaagctctcaggcaacattcaaaggatgctggatgtacactggttgaacatattgagtcaccatcatcaatatgggtgtttgctggggcccctgataggtgtccaccaacatgcttgtttgtcggagggatggctgagttaggtgccttcttttctatacttcaggatatgaggaacacaatcatggcttcaaaaactgtgggcacagctgatgaaaagcttcgaaagaaatcatcattctatcaatcatacctcaggcgcacacaatcaatgggaatacaactggaccagaggataattgtcatgtttatggttgcctggggaaaggaggcagtggacaactttcatctcggtgatgacatggatccagagcttcgtagcctggctcagatcctgattgatcagaaagtgaaggaaatctcaaaccaggaacctatgaagttataa

SEQ ID NO: 2890 - RNA, 1290 nt, synthetic construct
  misc_feature 1..1290: note = derived and/or modified CDS sequence (wt) from SEOV(JUN5-14)__DQ217791.1__N
  source 1..1290: mol_type = other RNA
atggcaactatggaggaattccagagagaaatcagtgctcacgaggggcagcttgtgatagcacgccagaaggttaaggatgcagaaaagcagtatgagaaggatcctgatgacttaaacaagagggcactgcatgatcgggagagtgtcgcagcttcaatacaatcaaaaattgatgaattgaagcgccaacttgccgacaggattgcagcaggaaaaaacatcgggcaagaccgggatcctacaggggtagagccgggtgatcatctcaaagaaagatcagcactaagttatgggaatacactggacctgaatagtcttgacattgatgaacctacaggacagacagctgattggttgaccataattgtctatctgacatcattcgtggtcccgatcattttgaaggcactgtacatgttaacaacaagaggtaggcagacttcaaaggacaacaaggggatgaggatcagattcaaggatgacagctcatatgaggatgtcaatggaatcagaaagcccaaacatctgtatgtgtcaatgccaaacgcccaatccagcatgaaagctgaagagataacacctggaagattccgtacggcagtatgtgggctatatcctgcacagataaaggcaagaaacatggtgagccctgtcatgagtgtagttgggtttttggcactggcgaaagactggacatctagaattgaagaatggcttggcgcaccttgcaagttcatggcggagtctcccattgccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgccggggcccctgataggtgtccaccaacatgcttgtttgtcggaggtatggctgagttaggtgccttcttttctatccttcaggatatgaggaacacaatcatggcttcaaaaactgtgggcacagctgatgaaaagcttcgaaagaaatcatcattctaccaatcatacctcagacgcacacaatcaatgggaatacaactggaccagaggataattgttatgtttatggttgcctggggaaaggaggcagtggacaacttccatctcggtgatgacatggatccagagcttcgtagcctggctcagatcctgattgaccagaaagtgaaggaaatctcaaaccaggaacctatgaaattataa

SEQ ID NO: 2891 - RNA, 1290 nt, synthetic construct
  misc_feature 1..1290: note = derived and/or modified CDS sequence (wt) from SEOV(L99)__AF488708.1__N
  source 1..1290: mol_type = other RNA
atggcaactatggaagaaatccagagagaaatcagtgctcacgaggggcagcttgtgatagcacgccagaaagtcaaggatgcagaaaagcagtatgaaaaggatcctgatgacttaaacaagaggacactgcatgatcgggagagtgtcgcagcttcaatacaatcaaaaattgatgaattgaagcgccaacttgccgacaggattgcagcagggaagaatattgggcaagaccgggatcctacaggggtagagccgggtgatcatctcaaagagagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcagacttcaaaggacaacaaagggatgaggatcagattcaaggatgacagctcatatgaggatgtcaatggaatcagaaaacccaagcatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtagttgggtttttggcactggcaaaagattggacatctagaattgaagaatggcttggtgcaccctgcaagtttatggcggaatctccaattgctgggagtttatctgggaatcccgtgaatcgtgactatatcagacagagacaaggtgcacttgcagggatggagccaaaggaatttcaagccctcaggcaacatgcaaaggatgctgggtgtacactggttgagcatattgagtcaccatcatcaatatgggtgtttgctggggcccctgataggtgtccaccaacatgtttgtttgtcggagggatggctgagttaggtgccttcttttctatacttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggacccagagcttcgtagcctggctcagatcctgattgaccagaaagtaaaagaaatctcgaaccaggaacctatgaaattataa

SEQ ID NO: 2892 - RNA, 1290 nt, synthetic construct
  misc_feature 1..1290: note = derived and/or modified CDS sequence (wt) from SEOV(R22)__AF488707.1__N
  source 1..1290: mol_type = other RNA
atggcaactatggaagaaatccagagagaaatcagtgctcacgaggggcagcttgtgatagcacgccagaaagtcaaggatgcagaaaagcagtatgaaaaggatcctgatgacttaaacaagagggcactgcatgatcgggagagtgtcgcagcttcaatacaatcaaaaattgatgaattgaagcgccaacttgccgacaggattgcagcagggaagaatattgggcaagaccgggatcctacaggggtagagccgggtgatcatctcaaagagagatcagcactaagctatgggaatacactggacctgaatagtcttgacattgatgaacctacaggacagacagctgattggttgaccataattgtctatctgacttcatttgtggtcccgatcatcttaaaggcactgtacatgttaacaacaagaggcaggcagacttcaaaggacaacaaagggatgaggatcagattcaaggatgacagctcatatgaggatgtcaatggaatcagaaaacccaaacatctgtatgtgtcaatgccaaacgcccaatccagcatgaaggctgaagagataacacctggaagattccgcactgcagtatgtgggctatatcctgcacagataaaggcaaggaacatggtgagccctgtcatgagtgtagttgggtttttggcactggcaaaagattggacatctagaattgaagaatggcttggtgcaccctgcaagtttatggcggaatctccaattgctgggagtttatctgggaatcccgtgaatcgtgactatatcagacagagacaaggtgcacttgcagggatggagccaaaggaatttcaagccctcaggcaacatgcaaaggatgctgggtgtacactggttgagcatattgagtcaccatcatcaatatgggtgtttgctggggcccctgataggtgtccaccaacatgtttgtttgtcggaaggatggctgaattaggtgccttcttttctatacttcaggatatgaagaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggacccagagcttcgtagcctggctcagatcctgattgaccagaaagtaaaagaaatctcgaaccaggaacctatgaaattataa

SEQ ID NO: 2893 - RNA, 1290 nt, synthetic construct
  misc_feature 1..1290: note = derived and/or modified CDS sequence (wt) from SEOV(TURCKHEIM/Hu/FRA/2016/2016.00044)__KX064270.1__N
  source 1..1290: mol_type = other RNA
atggcaactatggaagaaatccagagagaaatcagtgctcacgaggggcagcttgtgatagcacgccagaaagtcaaggatgcagaaaaacagtatgagaaggatcctgatgacttaaataagagggcactgcatgatcgggagagtgtcgcagcttcaatacagtcaaaaattgatgaattgaagcgccaacttgctgacaggattgcagcagggaagaacatcgggcaagaccgggatcctacaggggtagagccgggtgatcatctcaaggaaagatcagcactaagctacgggaatacactggacctgaatagccttgacattgatgaacctacaggacagacagctgattggctgaccataattgtctatttgacatcatttgtggtcccgatcatcttgaaggcactgtacatgttaacaacaagaggcaggcagacttcaaaggacaacaaggggatgaggatcagattcaaggatgacagctcatatgaagatgtcaatggaatcagaaagcccaaacatctgtatgtatcaatgccaaacgcccaatccagcatgaaggctgaagagataacacctggaagattccgcactgcagtatgtgggctatatcctgcacaaataaaagcaaggaacatggtaagccctgtcatgagtgtagttgggttcttggcactggcaaaagactggacatctagaattgaagaatggcttgacgcaccctgcaagttcatagcagagtcccccattgccgggagtttatctgggaatcctgtgaatcgtgattatatcagacagagacaaggtgcacttgcagggatggagccaaaggaatttcaagctctcaggcaacattcaaaggatgctggatgtacactggttgaacatattgagtcaccatcatcaatatgggtgtttgctggggcccctgataggtgtccaccaacatgcttgtttgttggagggatggctgagttaggtgccttcttttctatacttcaggatatgaggaacacaatcatggcttcaaaaactgtgggtacagctgatgaaaagcttcggaagaaatcatcattctatcaatcatacctcagacgcacacagtcaatgggaatacaactggatcagaggataattgttatgtttatggttgcctggggaaaggaggcagtggacaactttcatcttggtgatgacatggatccagagcttcgtagcctggctcagatcctgattgaccagaaagtgaaggaaatctcaaaccaggaacctatgaaattgtaa

SEQ ID NO: 2894 - RNA, 1290 nt, synthetic construct
  misc_feature 1..1290: note = derived and/or modified CDS sequence (wt) from SEOV(Z37)__AF187082.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgactttaacaagagggcactgcatgatcgggagagtgtcgcagcttcaatacaatcaaaaattgatgaattgaagcgccaacttgccgacaggattgcagcagggaagaacatcgggcaagaccgggatcctacaggggtagagccgggtgatcatctcaaggaaagatcagcactaagctatgggaatacactggacctgaatagtcttgacattgatgaacctacaggacagacagctgattggttgaccataattgtctatctaacatcatttgtggtcccgatcatcttgaaggcactgtacatgttaacaacaagaggtaggcagacttcaaaggacaacaaggggatgaggattagattcaaggatgacagctcatatgaggatgtcaatggaatcagaaagcccaaacatctgtatgtgtcaatgccaaatgcccaatccagcatgaaagctgaagagataacacctggaagattccgcacagcagtatgcgggctatatcctgcacagataaaggcaaggaacatggtaagccctgtcatgagtgtagttgggtttttggcactggcaaaagactggacatctagaattgaagaatggcttggcgcaccttgcaaattcatggcggagtctcccattgccgggagtttatctgggaatcctgtgaatcgtgactatatcagacagagacaaggtgcacttgcaggaatggagccaaaggaatttcaagccctcaggcaacatgcaaaggatgctggatgtacactggttgaacatattgagtcaccatcgtcaatatgggtgtttgctggggcccctgacaggtgtccaccaacatgcttgtttgtcggagggatggctgagttaggtgccttcttttctatccttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattggtatgtttatggttgcctggggaaaggaggcagtggacaactttcatcttggtgatgacatggacccagagcttcgtagcctggctcagatcctgattgaccagaaagtgaaggaaatctcaaaccaggaacctatgaaattataa

SEQ ID NO: 2895 - RNA, 1290 nt, synthetic construct
  misc_feature 1..1290: note = derived and/or modified CDS sequence (wt) from SEOV(Tchoupitoulas (TCH))__AF329389.1__N
  source 1..1290: mol_type = other RNA
atggcaactatggaggaaatccagagagaaatcagtgctcacgaggggcagcttgtgatagcacgccagaaggtcaaggatgcagaaaagcagtatgagaaggatcctgatgacttctacaagagggcactgcatgatcgggagagtgttgcagcttcaatacaatcaaaaattgatgaactgaagcgccaacttgccgacaggattgcagcagggaagaacatcgggcaagaccgggatcctacaggggtagagccgggtgatcatctcaaggaaagatcagcactaagctacgggaatacactggacctgaatagtcttgacattgatgaacctacaggacaaacagctgattggctgactataattgtctatctaacatcattcgtggtcccgatcatcttgaaggcactgtacatgttaacaacaagaggtaggcagacttcgaaggacaacaaggggatgaggatcagattcaaggatgacagctcatatgaagatgtcaatgggatcagaaagcctaaacatctgtatgtgtcaatgccaaacgcccaatccagcatgaaggctgaagagataacaccaggaagattccgcactgcagtatgtgggctatatcctgcacagataaaggcaaggaatatggtaagccctgtcatgagtgtagttgggtttttggcactagcaaaagactggacatctagaattgaagaatggcttggcgcaccctgcaagttcatggcagagtctcctattgctgggagtttatctgggaatcctgtgaatcgtgactatatcagacagagacaaggtgcacttgcagggatggagccgaaggaatttcaagccctcaggcaacattcaaaggatgctggatgtacactagttgaacatattgagtcaccatcgtcaatatgggtgtttgctggggctcctgataggtgtccaccaacatgtttgtttgttggagggatggctgagttaggtgccttcttttctatacttcaggatatgaggaacacaatcatggcttcaaaaactgtgggcacagctgatgaaaagcttcgaaagaaatcatcattctatcaatcatacctcagacgcacacaatcaatgggaatacaactggaccagagaataattgttatgtttatggttgcctggggaaaggaggcagtggacaactttcatctcggtgatgacatggatccagagcttcgtagcctggctcagatcttgattgaccagaaagtgaaggaaatctcgaaccaggaacctatgaaattataa

SEQ ID NO: 2896 - RNA, 1290 nt, synthetic construct
  misc_feature 1..1290: note = derived and/or modified CDS sequence (wt) from SEOV__M34881.1__N
  source 1..1290: mol_type = other RNA
atggcaactatggaagaaatccagagagaaatcagtgctcacgaggggcagcttgtgatagcacgccagaaggtcaaggatgcagaaaagcagtatgagaaggatcctgatgacttaaacaagagggcactgcatgatcgggagagtgtcgcagcttcaatacaatcaaaaattgatgaattgaagcgccaacttgccgacagattgcagcagggaagaacatccgggcaggaccgggatcctacaggggtagagccaggtgatcatcttaaggaaagatcagcactaagctacgggaatacactggacctgaatagtcttgacattgatgaacctacaggacagacagctgattggctgaccataattgtctatctgacatcattcgtggtcccgatcatcttgaaggcactgtacatgttaacaacacgaggtaggcagacttcaaaggacaacaaggggatgaggatcagattcaaggatgacagctcatatgaggatgtcaatggaatcagaaagcccaaacatctgtatgtgtcaatgccaaacgcccaatccagcatgaaggctgaagagataacaccaggaagattccgcactgcagtatgtggactatatcctgcacagataaaggcaaggaatatggtaagccctgtcatgagtgtagttgggttcttggcactggcaaaagactggacatcgagaattgaagaatggctcggtgcaccctgcaaattcatggcggagtctcttattgccgggagtttatctgggaatcctgtgaatcgtgactatatcagacagagacaaggtgcacttgcagggatggagccaaaggaatttcaagccctcaggcaacattcaaaggatgctggatgtacactagttgaacatattgagtcaccatcatcaatatgggtgtttgctggggcccctgataggtgtccaccaacatgcttgtttgtcggagggatggctgaattaggtgccttcttttctatacttcaggatatgaggaacacaatcatggcttcaaaaactgtgggcacagctgatgaaaagcttcgaaagaaatcatcattctatcaatcatacctcagacgcacacaatcaatgggaatacaactggaccagaggataattgttatgtttatggttgcctggggaaaggaggcagtggacaactttcatctcggtgatgacatggatccagagcttcgtagcctggctcagatcttgattgaccagaaagtgaaggaaatctcaaaccaggaacctatgaaattataa

SEQ ID NO: 2897 - RNA, 1287 nt, synthetic construct
  misc_feature 1..1287: note = derived and/or modified CDS sequence (wt) from SNV(H10)__NC_005216.1__N
  source 1..1287: mol_type = other RNA
atgagcaccctcaaagaagtgcaagacaacatcactctccacgaacaacaactcgtgactgccaggcagaagctcaaagatgcagaaagagcggtggaattggaccccgatgatgttaacaaaagcacattacagagcagacgggcagctgtgtctgcattggagaccaaactcggagaacttaagcgggaactggctgatcttattgcagctcagaaattggcttcaaaacctgttgatccaacagggattgaacctgatgaccatctaaaggaaaagtcatcattgagatatggaaatgtccttgatgtaaattccattgacttagaagagccaagtgggcaaacagctgattggaaatccatcggactctacattctaagtttcgcattaccgattattcttaaagccttgtacatgttatctactaggggccgtcaaacaatcaaagaaaacaagggaacaagaattcgattcaaggatgattcatcttatgaagaagtcaatgggatacgtaagccaagacatctgtatgtttctatgccaactgcccagtctacaatgaaagcagatgagattactcccgggaggttccgtacaattgcttgtggattattcccagcccaagtcaaagcaaggaatattatcagtcctgtcatgggtgtgattggctttagtttttttgtgaaagattggatggaaaggattgatgacttcctggctgcacgttgcccatttctgcctgagcagaaagaccctagagatgctgcattggcaactaatagagcctattttataacacgtcaattacaggttgatgagtcaaaggttagtgatattgaggacctgattgctgatgcaagggctgagtctgccactatattcgcagatattgctactcctcattcagtttgggtctttgcatgtgctccagatcgttgtccacctacagcattatatgtggccgggatgccggaactgggtgcattttttgctattctccaggatatgaggaacaccataatggcatccaaatctgtggggacatctgaagagaaattgaagaagaaatcagcattctaccagtcatacttaagacgtactcagtcaatgggaattcaactggaccagaagataatcatcttatacatgagccattggggaagagaggccgtgaatcacttccatcttggagatgatatggatcctgagcttagggaacttgcccagacccttgtagatatcaaggtcagggaaatctctaaccaagaaccacttaaactttaa

SEQ ID NO: 2898 - RNA, 1287 nt, synthetic construct
  misc_feature 1..1287: note = derived and/or modified CDS sequence (wt) from SNV(2)__JQ690282.1__N
  source 1..1287: mol_type = other RNA
atgagcaccctcaaagaagtgcaagacaacatcactctccacgaacaacaactcgtgactgccagacagaagctcaaagatgcagaaagagcggtggaactggaccccgatgatgttaacaaaagcacattacagagcagacgggcagctgtgtctgcattggagaccaaactcggagaactcaaacgggagctggctgatcttattgcagctcagaaattggcttcaaaacctgttgatccaacagggattgaacctgatgaccatctaaaggaaaaatcatcattacggtatggcaatgttcttgatgtaaattctattgacttggaagaaccaagtgggcagacagctgattggaaatctattgggctctacattttaagttttgcattaccaattattctcaaagccctgtacatgttgtctactaggggccgtcaaacaatcaaagagaacaaagggacaagaattcgatttaaggatgattcatcatatgaggaagttaacggaatacgcaagccaagacacctatatgtttctatgcctactgcccagtctacaatgaaagcagatgagatcactcctgggaggttccgtactatagcctgtgggctatttccagctcaagtcaaggccagaaacatcatcagtcctgtcatgggtgtgattggctttagcttttttgtaaaggattggatggaaagaattgatgacttcttggctgctcgctgcccttttttgcctgagcagaaagaccctagagatgctgcactggcaactaacagggcttatttcataacacgccagatgcaagttgatgagtcaaaggttagcgatattgaggacttaattgctgatgcaagggctgagtctgccacaatattcgcagatattgcaactccccactcagtatgggtctttgcatgtgctccagatcgctgtccacctacagcactatatgtggcagggatgccagaactaggtgcattctttgccattcttcaggatatgagaaacaccataatggcatcaaaatctgtaggaacatctgaagagaaattgaagaaaaaatcggcattctaccagtcatacctgagacgtactcaatctatggggattcagctggaccagaaaataatcatcctgtatatgagccattggggacgagaggctgtaaaccatttccaccttggggatgatatggatcctgaactcagggaacttgctcagacccttgtggacatcaaggttagggaaatctccaaccaagagccactcaagctgtaa

SEQ ID NO: 2899 - RNA, 1287 nt, synthetic construct
  misc_feature 1..1287: note = derived and/or modified CDS sequence (wt) from SNV(3)__JQ690278.1__N
  source 1..1287: mol_type = other RNA
atgagcaccctcaaagaagtgcaggacaacatcactcttcacgaacaacaactcgtgactgccagacaaaaactcaaagatgcagaaagggcggtggaactggaccccgatgatgttaacaaaagcacattacagagcagacgggcagctgtgtctgcattggagaccaaactcggagaactcaaacgggagctggctgatcttattgcagctcagaaactggcttcaaaacctgttgatccaacagggattgaacctgatgaccatttgaaggaaaaatcatcactacggtatggcaatgttcttgatgtgaattctattgacttagaagaaccaagcgggcaaacagctgattggaaatcgattggactctacatcttgagtttcgcattaccaattatcctcaaggccttatacatgttatctactagaggccgtcaaacaatcaaagagaacaaaggaacaagaattcgattcaaggatgattcatcatacgaggaagttaatggaatacgcaagccaagacatttatatgtctctatgcctactgcccaatccacaatgaaagcagatgagattactcccggaaggttccgtactattgcctgtgggctatttccagcccaagtcaaggctagaaacatcattagtcctgttatgggtgtgattgggtttagcttttttgtaaaagattggatggaaaggattgatgactttctggctgctcgttgcccttttttgcctgagcaaaaagaccctagagatgctgcactggcaaccaatagagcctatttcataacacgccaattgcaggttgatgaatcaaaagtcagcgatatcgaggacttgattgctgatgcaagggctgagtctgccactatatttgcagacattgcaactccccattcagtctgggtctttgcatgtgctccagatcgttgtccgcctacagcattatatgtggccgggatgccagagttgggtgcattctttgccattctccaggatatgagaaacaccataatggcatcaaaatctgtgggaacatctgaagaaaagctgaagaagaaatcagcattctatcagtcttacttaagacgtactcaatcaatggggattcagccagaccagaagataatcatattgtatatgagccactgggggagagaggctgtaaatcacttccatcttggagacgacatggatcctgaactcagggaacttgcacaaacccttgtggacattaaggtcagagagatctcgaaccaggaaccacttaaactgtaa

SEQ ID NO: 2900 - RNA, 1287 nt, synthetic construct
  misc_feature 1..1287: note = derived and/or modified CDS sequence (wt) from SNV(CC107/POR)__KT885046.1__N
  source 1..1287: mol_type = other RNA
atgagcaccctcaaagaagtgcaagacaacatcactcttcacgaacaacaactcgtgactaccagacagaagctcaaagatgcagaaagagcggtggaactggaccccgatgatgttaacaaaagcacattacagagcagacgggcagctgtgtctgcattggagaccaaactcggagaacttaaacgggagctggctgatcttattgcagctcagaaattggcttcaaaacctgttgatccaacagggattgaacctgatgaccatttgaaggaaaaatcatcattgaggtatgggaatgttcttgatgtgaattctatcgacttagaagagccgagtggtcagactgctgattggaaatccatcgggctttacatcttgagttttgccctaccgataattcttaaggccttatatatgttatccaccaggggccgtcaaacaattaaagagaacaaagggacgagaattcgatttaaggatgattcatcttatgaagaggtcaatgggatacgcaaaccaagacatctgtatgtttccatgcctactgctcaatctacaatgaaagcagatgaaatcactcctgggaggttccgtacaattgcttgtggcttgtttcctgctcaggtcaaggctagaaatatcatcagtcctgtcatgggtgtgattggatttagtttttttgttaaagattggatggagaggattgatgaatttctggctgctcgttgtccattcttgcctgaacaaaaagaccctagggatgccgcattagcaaccaacagagcctactttataacacgccagatgcaagttgatgagtcaaaagtcagtgatattgaagacttgattgctgatgcaagagctgaatcagccaccatatttgcagatattgctacccctcattctgtttgggtctttgcatgtgctcctgatcgttgtccacctacagcactatatgtggctgggatgccagagctgggtgcattctttgccattctccaggatatgagaaacaccataatggcatcaaagtctgtgggaacatctgaagaaaaactgaagaaaaaatctgcattttatcaatcctacttgaggcgaactcagtcaatggggattcaactggatcagaaaataattatcttatacatgagccactggggaagagaagctgtcaatcacttccaccttggagatgacatggatcctgagctcagggaacttgctcagactctcgtggacatcaaagttagggaaatttctaaccaggaaccacttaagctttaa

SEQ ID NO: 2901 - RNA, 1287 nt, synthetic construct
  misc_feature 1..1287: note = derived and/or modified CDS sequence (wt) from HPS(Convict Creek 107)__L33683.1__N
  source 1..1287: mol_type = other RNA
atgagcaccctcaaagaagtgcaagacaacatcactcttcacgaacaacaactcgtgactaccagacagaagctcaaagatgcagaaagagcggtggaactggaccccgatgatgttaacaaaagcacattacagagcagacgggcagctgtgtctgcattggagaccaaactcggagaacttaaacgggagctggctgatcttattgcagctcagaaattggcttcaaaacctgttgatccaacagggattgaacctgatgaccatttgaaggaaaaatcatcattgaggtatgggaatgttcttgatgtgaattctatcgacttagaagagccgagtggtcagactgctgattggaaatccatcgggctttacatcttgagttttgccctaccgataattcttaaggccttatatatgttatccaccaggggccgtcaaacaattaaagagaacaaagggacgagaattcgatttaaggatgattcatcttatgaagaggtcaatgggatacgcaaaccaagacatctgtatgtttccatgcctactgctcaatctacaatgaaagcagatgaaatcactcctgggaggttccgtacaattgcttgtggcttgtttcctgctcaggtcaaggctagaaatatcatcagtcctgtcatgggtgtgattggatttagtttttttgttaaagattggatggagaggattgatgaatttctggctgctcgttgtccattcttgcctgaacaaaaagaccctagggatgccgcattagcaaccaacagagcctactttataacacgccagatgcaagttgatgagtcaaaagtcagtgatattgaagacttgattgctgatgcaagagctgaatcagccaccatatttgcagatattgctacccctcattctgtttgggtctttgcatgtgctcctgatcgttgtccacctacagcactatatgtggctgggatgccagagctgggtgcattctttggcattctccaggatatgagaaacaccataatggcatcaaagtctgtgggaacatctgaagaaaaactgaagaaaaaatctgcattttatcaatcctacttgaggcgaactcagtcaatggggattcaactggatcagaaaataattatcttatacatgagccactgggggagagaagctgtcaatcacttccaccttggagatgacatggatcctgagctcagggaacttgctcagactctcgtggacatcaaagttagggaaatttctaaccaggaaccacttaagctttaa

SEQ ID NO: 2902 - RNA, 1287 nt, synthetic construct
  misc_feature 1..1287: note = derived and/or modified CDS sequence (wt) from HPS(Convict Creek 74)__L33816.1__N
  source 1..1287: mol_type = other RNA
atgagcaccctcaaagaagtgcaagacaacatcacacttcacgaacaacaactcgtgacttccagacagaagctcaaagatgcagaaagagcggtggaattggaccccgatgatgttaacaaaagcacattacagagcagacgggcagctgtgtctgcattggagaccaaactcggagaactcaaacgagagctggctgatcatattgcagctcagaaattggcttcaaaacctgttgatccaacagggattgaacctgatgaccatctaaaggagaaatcttcattaagatatggtaatgtccttgatgtaaactccattgacctagaagaaccgaacggccagacagctgattggaagtctattgggctatatattttgagttttgcactaccaattatccttaaggccttgtacatgttatctaccaggggccgtcagacaatcaaggaaaacaaggggacaagaattcgattcaaagatgattcatcctatgaggaagtcaatggaatacgtaagccaagacacctgtatgtttctatgcctactgctcaatccacaatgaaagcagatgagatcacccctggcaggttccgtacaattgcttgtgggttgtttccagctcaagtcaaggctagaaacataatcagccctgtcatgggtgtgattggttttagtttttttgtcaaagattggatggagaggattgatgaatttttggctgctcgctgtccatttttacctgagcaaaaagaccctagggatgctgcactggcaaccaatcgagcctatttcataacacgtcaattacaggttgatgaatcaaaggtgagtgatattgaagacttgattgctgatgcaagggctgaatctgccactatattcgcagatattgccactcctcactcagtctgggtttttgcatgtgcaccagatcgttgtccacccacagcattatatgtggcagggatgccagagctaggcgcattctttggaatccttcaggatatgagaaacaccataatggcatcaaaatctgtgggaacatctgaagagaagttgaagaaaaaatcagcattttaccagtcatatttaaggcgtactcagtcaatggggattcaactggatcagaaaataatcatcctgtacatgagccattgggggagagaggctgtgaatcactttcatcttggagatgatatggatcctgaactcagggaacttgcccagacccttgtggacatcaaggtcagggagatctctaaccaagaaccacttaaactttaa

SEQ ID NO: 2903 - RNA, 1287 nt, synthetic construct
  misc_feature 1..1287: note = derived and/or modified CDS sequence (wt) from HPS(H-NY1)__U47135.1__N
  source 1..1287: mol_type = other RNA
atgagcaccctcaaagaagtgcaagacaacattacattacacgaacaacagctcgtaactgccaggcagaagcttaaagatgcagaaaaggcagtggaagtggacccagatgacgttaacaaaagcacattacagggtagacgggcggctgtgtctgcattggaaaccaaactcggggagctcaaacgacagctggcagaccttattgcagctcagaaattggcttcaaaacctattgatccaacagggattgaacctgatgaccatttaaaggaaaaatcatcattgagatatgggaatgttcttgatgtgaattcaattgatttggaagaaccaagtggccaaacagcagattggaaagctattggaatgtatatcctgagctttgcaataccaatcatcttaaaggccctttatatgctatcaaccaggggtcgtcaaacagttaaggaaaataaagggacaagaatcaggttcaaggacgactcatcctatgaagaagtcaatgggatccgaaagccaagacatctgtacgtgtcaatgcctacagcccagtccacgatgaaggcagatgagatcactccagggcgtttccgcacgattgcatgtggattgttccctgcacaagtgaaagctaggaatattatcagtccagtcatgggtgtaataggatttaatttttttgttaaggattggatggacaggattgatgattttctagctgagcggtgcccattcctacctgagccaagagaccctaaggatgctgcattaggaacaaatagagcctattttataacacgtcaggcacaagtagatgaatcgaaggttgttgacattgaggaactgattgttgatgcaagagctgagtctgcaactcttttcacagacattgcaacgccccattcggtctgggtcttcgcatgtgcacctgacaggtgtccccctacagcattatatgttgctggaatgcctgaacttggcgcattttttgccatacttcaggatatgagaaacacaataatggcatcaaaatctgtagggacagctgaggagaaattaaagaaaaaatcggcattctaccaatcctaccttagacgaactcagtcaatgggaattcaactggatcaaaagataatcatcctttacatgattcattggggaaaggaagctgttaaccatttccaccttggtgatgatatggacccagagttgagggagttggcacaggccctcgttgatgctaaagttaaagagatttccaatcaggagccacttaaactgtaa

SEQ ID NO: 2904 - RNA, 1290 nt, synthetic construct
  misc_feature 1..1290: note = derived and/or modified CDS sequence (wt) from THAIV(Nakhon Ratchasima/Bi0017/2004)__AM397664.1__N
  source 1..1290: mol_type = other RNA
atggcaactatggaagagttacagagagaaattaatgcccacgaggggcaacttgtggtggcaagacagaaagtaaaggatgcagagaaacaatatgagaaagaccctgatgatttaaataggagggcacttcatgacagggagagtgtggctgcatcaattcagtcaaagattgatgagctaaaaaggcaacttgctgataggattgcatcagggaggacaattggccaagaccgtgacccaacaggtgtggaaccaggggaccatctgagagagagatcaatgttgagttacgggaatgtgctggatctcaacaatcttgatattgaggagccaacaggacagactgctgactggttgacaatcattgtttacctgacatcctttgtaatacctattattctcaaggcactgtatatgcttacaacaagaggaaggcaaacaacaaaggacaacaaagggatgagaattagatttaaggatgacagttcatatgaggatgtaaatgggattagaaagccaaagcacctttatatttcaatgccaaatgctcaatccagcatgaaagcagaggagataacaccaggaagattcaggactgcagtttgtgggctgtatccagcccaggtgaaagccagaaatatggtaagtcctgttatgagtgtcataggctttatggcacttgctaaggattggactgataggattcaagactggcttggggcaccatgtaagtttctacctgatctttcaacccaaagtctgcatgcaagtccaccaacaaatgcagattatattgcacagaggcagggacttcttgcagggatggaaactaaggagtcaaaaggtataagagaccatgcaagggatgctggctgtacccttgttgatcatcttgattctccatcttcaatctgggtctttgcaggtgcacctgatcgttgtccaccaacgtgcctcttcatcgcaggaatggctgaactaggggcctttttttcaatcctacaagatatgaggaacaccatcatggcctcaaagacagtgggaacatctgaagaaaagttaaaaaagaaatcatccttttatcagtcatacttgagaaggacacaatctatgggaattcaattggaccaacggatcatcgtcatgttcatggttgcatggggaaaagaggcagtggataacttccacctcggagacgacatggacccagaactcaggaatcttgcacagctattgattgaccaaaaagtcaaggagatttctaaccaagagccattgaaactctaa

SEQ ID NO: 2905 - RNA, 1290 nt, synthetic construct
  misc_feature 1..1290: note = derived and/or modified CDS sequence (wt) from TULV(Tula/Moravia/5302Ma/94)__NC_005227.2__N
  source 1..1290: mol_type = other RNA
atgagccaactcaaagaaatacaagaggaaatcacccgccatgaacagcaaattgtcattgcccggcaaaaacttaaagatgcagaaaagacggtggaagccgacccggatgatgttaacaagagcacactacagagtagacgggcagctgtgtcagcattggaggacaaactggcagacttcaagaggcagcttgcagatctggtgtcaagtcaaaaaatgggtgaaaagcctgttgacccgactgggcttgagccggatgatcacctcaaggagagatcaagccttcgatatggaaatgtccttgatgtgaatgctattgacatcgatgagccaagtggacagacagcagattggttttctatcggccagtacattacaggctttgcacttgcaataatcttgaaggcattgtatatgctgtcaactagagggaggcaaacaatcaaggaaaataaggggacaagaatccggtttaaggatgacagctcatatgaagaaatcaatggcattagacgcccgaaacatctgtatgtgtctatgccaacagcccagtctaccatgaaagccgatgaattgacaccaggtaggtttagaacaattgtttgtggactctttcctgctcaaattatgcacagaaacatcataagtcctgtcatgggtgtgattggattttcttttttcgttaaagattggcctgaaaagattgaggagttccttattaaaccctgcccattcctgaagaaaagtggtcctagtaaggaagaagattttcttgtgagtaatgatgcttaccttttaggacgtgaaaaggcattaagggagtcacaccttgctgagatagatgacttgattgaccttgcagcttcaggagacccaacaccaccagactctataaagtcaccacaagcaccatgggtgtttgcttgtcgaccagacaggtgccctcctacatgcatctatatagcagggatggcagagttgggagcatttttttccattctgcaggacatgaggaacacgattatggcatccaaaactgtgggcacagcagaggaaaaattgaagaaaaaatcctcattctatcagtcatatctgagacgcactcaatctatgggaatacaactggatcaaagaattatcttgctatttatgacagagtggggttctgatattgtcaaccacttccatctgggtgatgatatggaccctgagctcagaacacttgcacaaagtctcattgatcagaaggtcaaagagatttcaaaccaggaaccgctaaaaatctaa

SEQ ID NO: 2906 - RNA, 1293 nt, synthetic construct
  misc_feature 1..1293: note = derived and/or modified CDS sequence (wt) from TULV(D17-98)__AF289820.1__N
  source 1..1293: mol_type = other RNA
atgagccaactcaaagaaatacaagaagagatcacgcgccatgaacagcaaattgtcatcgcccgccagaagcttaaggatgcagagaaaacagtggaggccgacccggatgatgttaacaaaagtacacttcaaagcagacgggcagctgtgtcagcattggaggacaaactggcagatttcaagagacaacttgcagatctggtatcaagtcaaaaaatgggtgagaagcctgttgacccgactgggcttgagcctgatgatcaccttaaagaaagatcaagcctcagatatggaaatgtccttgatgtgaatgcaatcgatattgatgagcccagtggacaaacagcagattggttttcgatcggtcaatacatcataggctttgcacttgcaattgtcttgaaagctttatacatgttgtctacccggggaagacagacaatcaaggaaaacaagggcacaagaatcaggttcaaggatgacagctcgtatgaggaaataaatggaatccgacgccctaaacacttatatgtatcaatgccgactgcccagtccacaatgaaagcagatgagttaacaccaggccgattcaggacaattgtttgtgggctctttcctgcacaaataatgcatagaaacatcataagtcctgtgatgggtgtaattggattttcattttttgttaaggactggcctgataagatagaagaatttctcatcaaaccctgcccgtttctaaaaaaacaaggcggtcccaacaaagatgaggagtttcttgtgagttatgatgcataccttttgggaagagaaaaggcattgagggaatcacaccttgcggagattgatgatctgattgaccttgcagcctcaggggatcctacaccacctgactcaataaaatcgccacagggaccatgggtgtttgcttgtgcacctgatagatgccctccgacatgtatatatgtggccgggatggctgaactgggagctttcttttcgatcttgcaggatatgagaaatacaattatggcatccaaaacggtaggcacagcagaagagaagctaaagaagaaatcttcattttaccagtcctacttgcggcgcactcaatcaatgggtatacaactggaccagaggataatactgttgttcatgatggagtggggttctgatattgttaaccatttccacctgggtgatgatatggaccccgaacttagaacactggcacaaagtctcattgaccaaaaggtcaaggagatttcaaatcaggaaccattaaagatatga

SEQ ID NO: 2907 - RNA, 1293 nt, synthetic construct
  misc_feature 1..1293: note = derived and/or modified CDS sequence (wt) from TULV(D5-98)__AF289819.1__N
  source 1..1293: mol_type = other RNA
atgagccaactcaaagaaatacaagaagagatcacgcgccatgaacagcaaattgtcatcgcccgccagaagcttaaggatgcagagaaaacagtggaggccgacccggatgatgttaacaaaagtacacttcaaagcagacgggcagctgtgtcagcattggaggacaaactggcagatttcaagagacaacttgcagatctggtatcaagtcaaaaaatgggtgagaagcctgttgacccgactgggcttgagcctgatgatcaccttaaagaaagatcaagcctcagatatggaaatgtccttgatgtgaatgcaatcgatattgatgagcccagtggacaaacagcagattggttttcgatcggtcaatacatcataggctttgcacttgcaattgtcttgaaagctttatacatgttgtctacccggggaagacagacaatcaaggaaaacaagggcacaagaatcaggttcaaggatgacagctcgtatgaggaaataaatggaatccgacgccctaaacacttatatgtatcaatgccaactgcccagtccacaatgaaagcagatgagttaacaccaggccgattcaggacaattgtttgtgggctctttcctgcacaaataatgcatagaaacatcataagtcctgtgatgggtgtaattggattttcattttttgttaaggactggcctgataagatagaagaatttctcatcaaaccctgcccgtttctaaaaaaacaaggcggtcccaacaaagatgaggagtttcttgtgagttatgatgcataccttttgggaagagaaaaggcattgagggaatcacaccttgcggagattgatgatctgattgaccttgcagcctcaggggatcctacaccacctgactcaataaaatcgccacaggcaccatgggtgtttgcttgtgcacctgatagatgccctccgacatgtatatatgtggccgggatggctgaactgggagctttcttttcgatcttgcaggatatgagaaatacaattatggcatccaaaacggtaggcacagcagaagagaagctaaagaagaaatcttcattttaccagtcctacttgcggcgcactcaatcaatgggtatacaactggaccagaggataatactgttgttcatgatggagtggggttctgatattgttaaccatttccacctgggtgatgatatggaccccgaacttagaacactggcacaaagtctcattgaccaaaaggtcaaggagatttcaaatcaggaaccattaaagatatga

SEQ ID NO: 2908 - RNA, 1293 nt, synthetic construct
  misc_feature 1..1293: note = derived and/or modified CDS sequence (wt) from TULV(D63-98)__AF289821.1__N
  source 1..1293: mol_type = other RNA
atgagccaactcaaagaaatacaagaagagatcacacgccatgaacagcaaattgtcatcgcccgccagaagcttaaggatgcagagaaaacagtggaggccgacccggatgatgttaacaaaagtacacttcaaagcagacgggcagctgtgtcagcattggaggacaaactggcagatttcaagagacaacttgcagatctggtatcaagtcaaaaaatgggtgagaagcctgttgacccgactgggcttgagcctgatgatcaccttaaagaaagatcaagcctcagatatggaaatgtccttgatgtgaatgcaatcgatattgatgagcccagtggacaaacagcagattggttttcgatcggtcaatacatcataggctttgcacttgcaattgtcttgaaagctttatacatgttgtctacccggggaagacagacaatcaaggaaaacaagggcacaagaatcaggttcaaggatgacagctcgtatgaggaaataaatggaatccgacgccctaaacacttatatgtatcaatgccgactgcccagtccacaatgaaagcagatgagttaacaccaggccgattcaggacaattgtttgtgggctctttcctgcacaaataatgcatagaaacatcataagtcctgtgatgggtgtaattggattttcatttttcgttaaggactggcctgataagaaagaagaatttctcatcaaaccctgcccgtttctaaaaaaacaaggcggtcccaacaaagatgaggagtttcttgtgagtaatgatgcataccttttgggaagagaaaaggcattgagggaatcacaccttgcggagattgatgatctgattgaccttgcggcctcaggggatcctacaccacctgactcaataaaatcgccacagggaccatgggtgtttgcttgtgcacctgatagatgccctccgacatgtatatatgtggccgggatggctgaactgggagctttcttttcgatcttgcaggatatgagaaatacaattatggcatccaaaacggtaggcacagcagaagagaagctaaagaagaaatcttcattttaccagtcctacttgcggcgcactcaatcaatgggtatacaactggaccagaggataatactgttgttcatgatggagtggggttctgatattgttaaccatttccacctgggtgatgatatggaccccgaacttagaacactggcacaaagtctcattgaccaaaaggtcaaggagatttcaaatcaggaaccattaaagatatga

SEQ ID NO: 2909 - RNA, 1290 nt, synthetic construct
  misc_feature 1..1290: note = derived and/or modified CDS sequence (wt) from TULV(MG23/Omsk)__AF442621.1__N
  source 1..1290: mol_type = other RNA
atgagcaccctcaaagaaatacaggaagagatcacccgccatgagcagcagattgtcattgctcggcaaaaacttaaagatgcggagaagacggtggaggccgacccggatgatgttaacaaaaatacactccagagcagacgggcagctgtgtcaacattggaggacaaattggcagaattcaaaagacaacttgccgatctggtgtcaagtcaaaagatgggtgagaaacctgttgatccgactgggctggagccagacgaccaccttaaggaaagatctagcctcagatatggaaatgtccttgatgtgaatgctactgacattgatgagccaagtgggcagacagcagactggttttctatcggtcagtacataatgggatttgcacttgcaatcgtgcttaaggcgttgtacatgttgtcgacacgcgggagacaaaccatcaaggaaaataaagggacaagaattaagtttaaagatgacagttcaattgaggagattaacgggataagacgtccaaaacacctgtatgtctcaatgccaactgcacagtccacaatgaaagcagatgagttaacaccaggaagatttaggacaattgtctgtggcctcttccctgcccaaataatgcatagaaacatcatcagtccagtaatgggtgtaataggattctctttctttgtcaaagattggccagataagattgaggagttccttattaaaccatgtcccttcttgaaaaaacaaggttccaccaaagaagaagaatttcttgtgagcaatgatgcatacatgctcgggagggaaaaagcattacgggaatcacacctggctgaaattgatgagttgattgatcttgcagactcaggggacccaacaccgcctgactccatcaagtccccacaggcaccatgggtatttgcatgtgcaccagatagatgcccccctacatgtatttatattgctgggatggctgaacttggggcattcttttctatactccaggacatgagaaatacaatcatggcatctaagactgttggaacagcagaggaaaagttaaagaaaaaatcatcattttatcagtcttatttgcggcgcactcaatcaatgggaatacaactggaccaaaggattatcctgctttttatgatggagtggggttctgatattgtcaaccatttccatctgggtgatgatatggaccctgaactcagaacacttgcacaaagtctcattgaccagaaggtcaaggagatttcaaaccaggagccattgaaaatctaa

SEQ ID NO: 2910 - RNA, 1290 nt, synthetic construct
  misc_feature 1..1290: note = derived and/or modified CDS sequence (wt) from TULV(c109-s)__AF164094.1__N
  source 1..1290: mol_type = other RNA
atgagccaactcaaagaaatacaggaggagatcacccgccatgaacagcagattgtcatcgcccggcaaaaactcaaagatgcagaaaagacagtggaagccgacccagatgatgttaacaaaagcacactacagagtagacgggcagctgtgtcagcattggaggacaaactggcagacttcaagaggcagcttgcagatttggtatcaagtcaaaaaatgggtgaaaagcctgttgacccgactgggcttgagccggatgatcatctcaaggagaggtcaagtcttagatatggaaatgtccttgatgtgaatgctatagatattgatgaaccaagtggacaaacagcagactggttttctattggccaatacatcacaggattcgcacttgctataatcttgaaggcattgtacatgctgtcaaccagagggagacaaacaatcaaggaaaataaggggacaagaattcggtttaaggatgacagctcttatgaagaaattaatggcattagacgaccaaagcatctgtatgtgtctatgcctacagcccaatctaccatgaaagcggatgagttgacaccaggtagattcaggacaattgtctgtggactcttccctgctcagattatgcacagaaacatcataagtcctgtcatgggtgtaattggcttttctttttttgtcaaggactggcctgaaaagattgaggagtttcttatcaagccctgcccattcctaaagaaaagtggccctagtaaggaggaagattttcttgtgagtaatgatgcatatcttctagggcgtgaaaaagcattgagggaatcacaccttgctgagattgatgatttgattgaccttgcagcctcaggagacccaacaccaccagattctataaaatcaccacaagcaccatgggtattcgcctgtgcaccagataggtgccctcctacatgcatttatatagcagggatggcagagttaggggctttcttctccattctgcaggacatgaggaatacgattatggcatctaagactgtgggtacttcagaagagaagttaaagaagaagtcctcgttctatcagtcttatctgaggcgcacccaatctatgggaatacaactggatcaaaggattatcctgctatttatgacagagtggggttctgatattgtcaaccatttccatctgggtgatgatatggaccctgaactcagaacacttgcacaaagtctcattgaccaaaaagttaaagagatttcaaaccaggaaccattgaaaatctga

SEQ ID NO: 2911 - RNA, 1290 nt, synthetic construct
  misc_feature 1..1290: note = derived and/or modified CDS sequence (wt) from TULV(CHEVRU/Hu/FRA/2015/15.00453)__KT946591.1__N
  source 1..1290: mol_type = other RNA
atgagccaactcaaagaaatacaggaggaaatcacccgccatgagcagcagattgtcattgcccggcaaaaacttaaagatgcagaaaagacagtggaggccgacccggatgatgttaacaagagtacactacagagcagacaggcggctgtgtcagcattggaagacaaattggcagacttcaagagaaagcttgcagatttggtatcaagtcaaaagatgggtgaaaaacctgttgacccaactgggcttgaacctgatgaccacctcaaggagagatcaagtcttagatatggaaatgtccttgatgtgaatgctattgacattgatgaaccaagtgggcaaacagctgattggttctccattggtcagtatgtcatggggtttgcacttgcaatcatcctgaaagcattgtacatgttatcgactagggggagacaaacaatcaaggagaataaagggacaagaattcgattcaaggatgacagttcttatgaggaaattaatggtatcagacggcccaaacatctttatgtgtccatgccaacagcccaatctaccatgaaagcagatgagttgacaccaggtagatttcgaacaattgtttgtggactcttccctgcccaaattatgcacagaaacattataagtcctgtgatgggtgtgatcggcttttctttttttgtaaaagactggcctgagaaaattgaggagtttttaataaaaccatgtccgtttctaaagaaaagtggccctagcaaagaggaagattttttggtaagtaatgatgcttatctcttagggcgtgaaaaggcattgagggattcacaccttgctgagattgatgatttgattgatcttgcagaatcaggggatccaaccccaccagactccataaaatcaccacaggcaccttgggtatttgcttgtgcacctgacaggtgtcctccaacatgtatttacatagcagggatggctgaactgggggccttcttttccatcttacaagacatgaggaatacaattatggcatccaagactgtgggcactgctgaggaaaaactgaaaaagaaatcttcattttatcagtcctatttaaggcgcactcagtccatggggatacaactggatcagagaatcatcttgttgtttatgatagaatggggttctgacattgtcaaccattttcatcttggtgatgatatggaccctgagctaaggacacttgcacagagtctcattgaccaaaaggtcaaagagatctctaatcaggaaccactgaaaatctga

SEQ ID NO: 2912 - RNA, 1290 nt, synthetic construct
  misc_feature 1..1290: note = derived and/or modified CDS sequence (wt) from TULV(g20-s)__AF164093.1__N
  source 1..1290: mol_type = other RNA
atgagccaactcaaagaaatacaggaggagatcacccgccatgaacagcagattgttatcgcccggcaaaaacttaaagatgcagaaaaaacagtggaggccgacccagatgatgttaacaaaagtacactacagagcagacaggcggctgtgtcagcattggaagacaaattggcagacttcaagaggaagcttgcagatctggtatcaagtcaaaaaatgggtgaaaagcctgttgacccgactgggcttgagccagatgaccatctcaaggagagatcaagcctcagatatggaaatgtccttgatgtgaatgctattgacattgatgaaccaagtggacaaacagctgattggttttctattggccagtatgttatgggttttgcacttgcaatcatcttgaaagcattgtatatgttgtcaactaggggaaggcaaacaattaaagagaataaaggaacaagaatccgatttaaagatgacagttcttatgaggaaatcaatggcattagacgacccaagcacctttatgtatccatgccgacagcacagtctaccatgaaagcagatgagttaacaccgggtaggtttagaacaatcgtttgtggacttttccctgcacaaattatgcacagaaatataataagtcctgtgatgggtgttattggtttttcttttttcgtaaaggattggccagaaaagattgaggagttcttgataaaaccatgtccctttctaaaaaaaagtggccctagtaaggaggaggactttcttgtgagtaatgatgcttacttattagggcgtgaaaaggcattgagggattcacaccttgctgagattgatgacttgattgaccttgcagaatcaggggacccaacaccgccagattctataaagtcaccacaggcaccatgggtgtttgcttgtgcacctgacagatgccctccaacatgcatttacatagcagggatggcagagctaggagctttcttttccattctccaagacatgaggaacacaatcatggcatctaaaactgtgggcactgccgaagaaaaactaaaaaagaaatcttcattctatcagtcttatctgaggcgcactcaatccatggggatacaactggatcaaaggattatattgctgttcatgacagaatggggatctgatattgtcaatcattttcaccttggtgatgatatggatcctgaactcaggacacttgcacaaagtctcattgaccagaaggtcaaggagatttcgaaccaggagccattaaaaatctaa

SEQ ID NO: 2913 - RNA, 1293 nt, synthetic construct
  misc_feature 1..1293: note = derived and/or modified CDS sequence (wt) from TULV(Sennickerode Sen05/174)__EU439948.1__N
  source 1..1293: mol_type = other RNA
atgagccaactcaaagaaatacaggaggagatcacccgccatgaacagcagattgtcatcgctcgtcaaaaacttaaagatgcagagaagacagtggaggccgacccagatgatgttaacaagagtacacttcagagtagacgggcagctgtgtcagcattggaggacaaacttgcagacttcaagagacaacttgcagatttggtatcgagtcagaaaatgggtgagaagcctgttgacccgactgggcttgagccagatgaccatctcaaagagagatccagtctcagatatggaaatgtccttgatgtaaatgccattgatattgatgaaccaagtggacagacagcagattggttttcgattgggcaatacatcattgggtttgcactggctattgtcctaaaggcattgtacatgttgtcaactcgtggaaggcagacaattaaagagaacaaaggcactagaattaggtttaaggatgacagctcatttgaagaaattaacgggataaggcgaccaaagcatttatatgtctcaatgccaactgcccaatccaccatgaaagctgatgagttaacaccaggcaggtttaggacaattgtgtgtggattattccctgctcagataatgcacaggaatataataagtcctgtcatgggtgtgattggattctccttctttgtcaaggactggccggacaagattgaagaatttctcataaaaccttgcccattcctaaagaaacaaggtggccccaacaaggatgaagactttttggtcagcaatgatgcatattttttagggcgtgagaaggcattaagggaatcacatctgaatgagattgatgacctaattgagcttgcagcctcaggagatcctacaccaccagactccataaagtcaccgcaggcaccatgggtttttgcttgtgcaccagatagatgccctcctacatgcatctatgtggccggaatggcagagcttggtgcatttttttcaatcctccaggatatgagaaatactattatggcctccaaaactgtgggcacagcagaagagaagttaaaaaagaagtcatcgttctatcaatcatacctccgacgcacacagtccatggggatacaactggatcaaaggattatcctgctgttcatgatggagtggggttctgatattgtcaaccactttcatctgggtgatgatatggaccctgaacttcgtacacttgcacaaagtctcattgaccaaaaggtcaaagagatttcaaatcaggagccattaaaaatctaa

SEQ ID NO: 2914 - RNA, 1293 nt, synthetic construct
  misc_feature 1..1293: note = derived and/or modified CDS sequence (wt) from TULV(Sennickerode Sen05/175)__EU439949.1__N
  source 1..1293: mol_type = other RNA
atgagccaactcaaagaaatacaggaggagatcacccgccatgaacagcagattgtcatcgctcgtcaaaaacttaaagatgcagagaagacagtggaggccgacccagatgatgttaacaagagtacacttcagagtagacgggcagctgtgtcagcattggaggacaaacttgcagacttcaagagacaacttgcagatttggtgtcgagtcagaaaatgggtgagaagcctgttgacccgactgggcttgagccagatgaccatctcaaagagagatccagtctcagatatggaaatgtccttgatgtaaatgccattgacattgatgaaccaagtggacagacagcagactggttttcgattgggcaatacatcattgggtttgcactggctattgtcttaaaggcattgtacatgttgtcaactcgtggaaggcagacaattaaagagaacaaaggcactagaattaggtttaaggatgacagctcgtttgaagaaattaacgggataaggcgaccaaagcatttatatgtctcaatgccaactgcccaatctaccatgaaagctgatgagttaacaccaggcaggtttaggacaattgtgtgtggattattccctgctcagataatgcacaggaatataataagtcctgtcatgggtgtgattggattctccttctttgtcaaggactggccggacaagattgaagaatttctcataaaaccttgcccattcctaaagaaacaaggtggccccaacaaggatgaagactttttggtcagcaatgatgcatattttttagggcgtgagaaggcattaagggaatcacacctgaatgagattgatgacctaattgagcttgcagcctcaggagatcctacaccaccagactccataaagtcaccacaggcaccatgggtttttgcctgtgcaccagatagatgccctcctacatgcatctatgtggccggaatggcagagcttggtgcatttttttcaatcctccaggatatgagaaaatctattatggcctccaaaactgtgggcacagcagaagagaagttaaaaaagaagtcatcgttctatcaatcatacctccgacgcacacagtccatggggatacaactggatcaaaggattatcctgctgttcatgatggagtggggttctgatattgtcaaccactttcatctgggtgatgatatggaccctgaacttcgtacacttgcacaaagtctcattgaccaaaaggtcaaagagatttcaaatcaggagccattaaaaatctaa

SEQ ID NO: 2915 - RNA, 1293 nt, synthetic construct
  misc_feature 1..1293: note = derived and/or modified CDS sequence (wt) from TULV(TUL/Karatal/Ma322/2003)__AM945877.1__N
  source 1..1293: mol_type = other RNA
atgagccaactcaaagaaatacaggaggagatcacccgccatgaacagcagattgtcattgctcggcaaaaactcaaagatgcagagaagacagtggaggccgacccagatgatgttaacaagaatacactccagagcagacgggcagctgtgtcagcattggaggacaaattggcagaattcaagagacagcttgccgatctggtatcaagtcagaaaatgggtgagaagcctgttgatccgactgggcttgagccagatgatcacctcaaggagagatccagtctcagatatggaaatgtccttgatgtaaatgctattgatattgatgagccaagtggacaaacagcagattggttttctattgggcagtatgttatgggctttgctttggcaattgtcttgaaagcattatacatgctatctacccgtggaaggcaaacaatcaaagaaaataaggggacacgaatcagattcaaagatgacagttcatttgaggagatcaatgggataaggcggccaaaacacctgtatgtctcaatgcctactgcacagtctaccatgaaagcagatgaactaacacccggtcgtttccggactattgtctgtggcttgtttcctgctcaaatcatgcatagaaacataataagtcctgttatgggtgtgatcggattttcattctttgtcaaggactggccagaaaagattgaggaattcctgatcaaaccatgtccatttttaaagaaacaaggcagctcaggcaaggaggaggaatttcttgtgagtaatgatgcatacttaattggtagggaaaaaacattgcaagagtcacacttgactgagattgatgatttgattgatctagcagactcaggagatcctacaccaccagactctataaaatctccacaagcaccatgggtttttgcctgtgcgcctgatcgatgccctcccacttgtatttatatagctgggatggctgaacttggtgctttcttttcaatactccaggatatgaggaatacaatcatggcttctaagactgtgggaacagcagaggagaaattgaaaaagaaatcatctttctatcagtcctacctaaggcgcactcaatcaatgggaatccaactggaccaaaggattatcttgctgttcatgatggagtggggttctgatattgtcaaccatttccatttgggcgatgatatggaccctgaactaagaacacttgctcagagtctcattgatcaaaaggtcaaggagatttcaaaccaggaaccactgaaaatctga

SEQ ID NO: 2916 - RNA, 1293 nt, synthetic construct
  misc_feature 1..1293: note = derived and/or modified CDS sequence (wt) from TULV(Tula/Kosice144/Ma/95)__Y13979.1__N
  source 1..1293: mol_type = other RNA
atgagccaactcaaagaaatacaggaggagatcacccgccatgaacagcagatcgtcattgctcggcaaaaactcaaggatgcagagaagacagtggaggccgacccggatgatgttaataaaagtacactacagagcagacgggcagctgtgtcagcattggaggacaagttggcagacttcaagaggcagcttgcagatttggtatcaagtcaaaaaatgggtgaaaagcctgttgacccgactgggcttgagccggatgaccatctcaaggagagatctagcctcagatatggaaatgtccttgatgtgaatgccattgatattgatgagccaagtggtcaaacagcagactggttctccattggacaatacattatagggtttgcactagcaatagtcctaaaggcattatacatgttatcaacaagaggaaggcagacaattaaggaaaacaaggggactagaatcaggttcaaagatgacagttcctttgaggagatcaatggcatacggcgtcctaagcacctctatgtgtcaatgcctactgcacagtccactatgaaagctgatgagttaacaccaggtaggtttagaacaattgtttgtggacttttcccggctcaaatcatgcacagaaatatcataagtccagtcatgggtgttattgggttttcattctttgtgaaagactggcctgagaagatcgaagaatttttaattaagccttgtccttttttaaagaaacaaggtgcacctgggaaagaggaagactttcttgtcagcaatgatgcttatctccttgggcgggaaaaagcattgagggaatcacacctggctgagattgatgacttgattgatcttgcagcatcaggggatccaacaccgccggactctataaaatcaccacaagccccgtgggtgtttgcctgtgcacctgatagatgccctcctacatgcatttacattgctgggatggcagagttaggtgccttcttctcaatcctacaggatatgaggaacacaatcatggcatccaagacagttggcactgctgaggagaagctgaagaaaaaatcttctttttatcaatcatacttgagacgcactcagtcaatgggaatacaactggatcagaggattattctgctgttcatgacggaatggggttcagatattgtcaaccatttccatcttggagatgatatggacccagagctccggacacttgcacaaagtctcattgatcaaaaggtcaaggagatatctaaccaggaaccattgaaaatctag

SEQ ID NO: 2917 - RNA, 1293 nt, synthetic construct
  misc_feature 1..1293: note = derived and/or modified CDS sequence (wt) from TULV(Tula/Kosice667/Ma/95)__Y13980.1__N
  source 1..1293: mol_type = other RNA
atgagccaactcaaagaaatacaggaggagatcacccgccatgaacagcagatcgtcattgctcggcaaaaactcaaggatgcagagaagacagtggaggccgacccggatgatgttaataaaagtacactacagagcagacgggcagctgtgtcagcattggaggacaaattggcagacttcaagaggcagcttgcagatttggtatcaagtcaaaaaatgggtgaaaagcctgttgacccgactgggcttgagccggatgaccatctcaaggagagatctagtctcagatatggaaatgtcctggatgtgaatgccattgatattgatgagccaagtggtcaaacagcggactggttttccattggacaatacattatagggtttgcactagcaatagtcctaaaggcattatacatgttatcaacaagaggaaggcagacaattaaggaaaacaaggggactaggatccggttcaaagatgacagttcctttgaggagatcaatggcatacggcgtcctaagcacctctatgtgtcaatgcccactgcacagtccactatgaaagctgatgagttaacaccaggtaggtttagaacaattgtctgtggacttttcccggctcaaattatgcacaggaatatcataagtccagtcatgggtgttattgggttttcattctttgtgaaagactggcctgagaagatcgaagaatttttaattaaaccctgtccttttttaaagaaacaaggtgcacctgggaaagaagaagactttcttgtcagcaatgatgcttatctccttgggcgggaaaaagcattgagggaatcacacttggctgagattgatgacttgattgatcttgcagcatcaggggatccaacaccaccggactctataaaatcaccacaggccccatgggtgtttgcctgtgcacctgatagatgccctcctacatgcatttacattgctgggatggcagagttaggtgccttcttctcaatcctacaggatatgagggacacaatcatggcatctaagacagtgggcactgctgaggagaagttgaagaaaaaatcttccttttatcaatcatacttgaggcgtactcagtcaatggggatacaactggatcagaggattattctgctgttcatgacggaatggggttcagatattgtcaatcattttcatcttggagatgatatggacccagaactccggacacttgcacagagtctcattgatcaaaaggtcaaggagatatctaaccaggaaccattgaaaatctag

SEQ ID NO: 2918 - RNA, 1290 nt, synthetic construct
  misc_feature 1..1290: note = derived and/or modified CDS sequence (wt) from TULV(Tula/Koziky/5247Ma/94)__AJ223600.1__N
  source 1..1290: mol_type = other RNA
atgagccaactcaaagaaatacaagaggagatcacccgccatgaacagcaaattgtcattgcccggcaaaaacttaaagatgcagaaaagacggtggaagccgacccggatgatgttaacaagagcacactacagagtagacgggcagctgtgtcagcattggaggacaagctggcagacttcaagaggcagcttgcagatctggtgtcaagtcaaaagatgggtgaaaagcctgttgacccgactgggcttgagccggatgatcacctcaaggagagatcaagccttcgatatggaaatgtccttgatgtgaatgctattgacatcgatgagccaagtggacagacagcagattggttttctatcggccagtacattacaggctttgcacttgcaataatcttgaaggcattgtatatgctgtcgactagagggaggcaaacaatcaaggaaaataagggaacaagaatccggttcaaggatgacagctcatatgaagagatcaatggcattagacgcccgaaacatctatatgtgtctatgccaacagcccagtctactatgaaagccgatgaattgacaccaggtaggtttagaacaattgtttgtggactctttcctgctcaaattatgcacagaaacatcataagtcctgtcatgggtgtgattggattttcttttttcgttaaagattggcctgaaaagattgaggagttccttattaaaccctgcccattcctgaagaaaaatggtcctagtaaggaagaggattttcttgtgagtaatgatgcttaccttttaggacgtgaaaaggcactaagggaatcacaccttgctgagatagatgacttgattgaccttgcagcttcagaagacccgacaccaccagactctataaagtcaccacaggcaccatgggtgtttgcttgtcgaccagacaggtgccctcccacatgcatctatatagcagggatggcagagttaggagcatttttttccattcttcaggacatgaggaacacgattatggcatccaaaactgtgggcacagcagaagagaagttaaagaaaaaatcctcattctatcagtcatatctgagacgcactcaatctatgggaatacaactggatcagagaatcatcttgctatttatgacagagtggggttctgatattgtcaaccatttccatctgggcgatgatatgagccctgagctcagaacacttgcacaaagtctcattgaccagaaggttaaagagatttcaaaccaggaaccattaaaaatctaa

SEQ ID NO: 2919 - RNA, 1290 nt, synthetic construct
  misc_feature 1..1290: note = derived and/or modified CDS sequence (wt) from TULV(Tula/Moravia/5302v/95)__Z69991.1__N
  source 1..1290: mol_type = other RNA
atgagccaactcaaagaaatacaagaggaaatcacccgccatgaacagcaaattgtcattgcccggcaaaaacttaaagatgtagaaaagacggtggaagccgacccggatgatgttaacaagagcacactacagagtagacgggcagctgtgtcagcattggaggacaaactggcagacttcaagaggcagcttgcagatctggtgtcaagtcaaaaaatgggtgaaaagcctgttgacccgactgggcttgagccggatgatcacctcaaggagagatcaagccttcgatatggaaatgtccttgatgtgaatgctattgacatcgatgagccaagtggacagacagcagattggttttctatcggccagtacattacaggctttgcacttgcaataatcttgaaggcattgtatatgctgtcaactagagggaggcaaacaatcaaggaaaataaggggacaagaatccggtttaaggatgacagctcatatgaagaaatcaatggcattagacgcccgaaacatctgtatgtgtctatgccaacagcccagtctaccatgaaagccgatgaattgacaccaggtaggtttagaacaattgtttgtggactctttcctgctcaaattatgtacagaaacatcataagtcctgtcatgggtgtgattggattttcttttttcgttaaagattggcctgaaaagattgaggagttccttattaaaccctgcccattcctgaagaaaagtggtcctagtaaggaagaagattttcttgtgagtaatgatgcttaccttttaggacgtgaaaaggcattaagggagtcacaccttgctgagatagatgacttgattgaccttgcagcttcaggagacccaacaccaccagactctataaagtcaccacaagcaccatgggtgtttgcttgtcgaccagacaggtgccctcctacatgcatctatatagcagggatggcagagttgggagcatttttttccattctgcaggacatgaggaacacgattatggcatccaaaactgtgggcacagcagaggaaaaattgaagaaaaaatcctcattctatcagtcatatctgagacgcactcaatctatgggaatacaactggatcaaagaattatcttgctatttatgacagagtggggttctgatattgtcaaccacttccatctgggtgatgatatggaccctgagctcagaacacttgcacaaagtctcattgatcagaaggtcaaagagatttcaaaccaggaaccgctaaaaatctaa

SEQ ID NO: 2920 - RNA, 1293 nt, synthetic construct
  misc_feature 1..1293: note = derived and/or modified CDS sequence (wt) from TULV__AF017659.1__N
  source 1..1293: mol_type = other RNA
atgagccaactcaaagaaatacaagaggagatcacccgccatgagcagcagattgtcattgcccggcaaaagctcaaggatgcagagaagacggtggaggccgacccggatgatgttaacaagagtacattacagagcagacgggcagctgtgtcagcattggaggacaagttggcagacttcaagagacagcttgcagatttggtatcaagtcaaaagatgggtgaaaagcctgttgacccgactgggcttgaaccggacgaccacctcaaggagagatctagcctcagatatggaaatgtccttgatgtgaatgccattgatattgatgagccaagtggtcaaacagcagattggttttctattggacagtacattatagggtttgcactagcaattgtcttgaaagcattgtatatgttgtcaacaagaggtaggcagacaattaaagaaaacaaagggacgagaattaggtttaaagatgatagctcctttgaagagatcaatggcatacggcgtcctaagcatctttatgtgtcaatgcccactgcacaatccaccatgaaagctgacgagttaacacctggtaggttcagaacaattgtctgtggactttttccagctcagatcatgcataggaacatcataagtcctgtcatgggtgtcattggattttcattttttgttaaagattggcctgagaagattgaggaattcttaattaaaccctgccctttcttaaaaaagcaaggtgcacctgggaaagaagaggacttcctcgtaagcaatgatgcttatctgctcgggcgagagaaagcactacgggaatcacacttggctgagattgatgacttgattgaccttgcagcttcaggggatccaacaccaccagactctataaagtcaccacaagccccatgggtgtttgcttgtgcacctgataggtgtcctccaacatgtatttatgttgctgggatggcagagctaggagcctttttctcaatccttcaggatatgaggaatacaatcatggcatctaaaacagtgggcactgctgaggagaagttaaagaagaaatcctccttttatcagtcatacttgagacgcactcagtcaatgggaatacaactggatcagaggattattctgttgtttatgacagaatggggttcagatattgtcaaccatttccaccttggtgatgatatggacccagaactccggacacttgcacaaagtctcattgaccaaaaggtcaaagagatatctaaccaggaaccattaaaaatctag

SEQ ID NO: 2921 - RNA, 1293 nt, synthetic construct
  misc_feature 1..1293: note = derived and/or modified CDS sequence (wt) from TULV(Lodz-1)__AF063892.1__N
  source 1..1293: mol_type = other RNA
atgacggaactcaaagaaatacaagaagagattacgcgccatgaacagcagattgtcattgcccgccaaaaacttaaagatgcagagaaaacagtggaggccgacccggatgatgttaacaaaagcacacttcaaagcagacgggcagctgtgtcagcattggaggacaaactggcagatttcaagagacaacttgcagatctggtatcaagtcaaaaaatgggtgaaaagcctgttgacccgactgggcttgagcctgatgatcatcttaaggaaagatcaagcctcagatatggaaatgtccttgatgtgaatgcaattgatattgatgagccaagtgggcaaacagcagactggttttcaattggtcagtacattatgggctttgcgcttgcaattgtcttgaaagccttgtatatgctgtccacccgaggtaggcagacaataaaggagaacaagggcacaagaatcagattcaaggatgacagttcatatgaagaaataaatggaatccgacgccctaagcatttatatgtgtcaatgccaactgcccagtccacaatgaaagcagacgagttaacaccaggtcggtttaggacaattgtttgtgggcttttccctgcacaaataatgcataggaacatcataagccctgtgatgggtgtgattggattctcattctttgttaaagactggcctgataagatagaagagtttctcatcaagccgtgcccattcttgaaaaagcaaggtggtcccaacaaggatgaagaatttctcgtgagtaatgatgcatatctcctaggaagagagaaggcactgagggaatcacaccttgcagagattgatgacctaattgatcttgcagcctcaggagatcccacaccacctgactcaataaaatcaccacaggcaccatgggtgtttgcttgtgcacctgatagatgccccccaacatgtatatatgtggctgggatggctgaattaggagccttcttctcaatcctacaggatatgagaaacacaatcatggcatctaagacagtgggcacagcagaagagaagctgaagaagaagtcctcgttttaccaatcctatttgcggcgcactcaatcgatgggtatacaactggatcaaaggataatattgctgttcatgatggagtgggggtctgatattgtcaatcatttccatctgggtgatgatatggaccctgaactcaggacactagcacagagtctcattgatcagaaggtcaaagagatttcaaatcaggaaccattaaagatataa

SEQ ID NO: 2922 - RNA, 1293 nt, synthetic construct
  misc_feature 1..1293: note = derived and/or modified CDS sequence (wt) from TULV(Lodz-2)__AF063897.1__N
  source 1..1293: mol_type = other RNA
atgacggaactcaaagaaatacaagaagagattacgcgccatgaacagcagattgtcattgcccgccaaaaacttaaagatgcagagaaaacagtggaggccgacccggatgatgttaacaaaagcacacttcaaagcagatgggcagctgtgtcagcattggaggacaaactggcagatttcaagagacaacttgcagatctggtatcaagtcaaaaaatgggtgaaaagcctgttgacccgactgggcttgagcctgatgatcatcttaaggaaagatcaagcctcagatatggaaatgtccttgatgtgaatgcaattgatattgatgagccaagtgggcaaacagcagactggttttcaattggtcagtacattatgggctttgcgcttgcaattgtcttgaaagccttgtatatgctgtccacccgaggtaggcagacaataaaggagaacaagggcacaagaatcagattcaaggatgacagttcatatgaagaaataaatggaatccgacgccctaagcatttatatgtgtcaatgccaactgcccagtccacaatgaaagcagacgagttaacaccaggtcggtttaggacaattgtttgtgggcttttccctgcacaaataatgcataggaacatcataagccctgtgatgggtgtgattggattctcattctttgttaaagactggcctgataagatagaagagtttctcatcaagccgtgcccattcttgaaaaagcaaggtggtcccaacaaggatgaagaatttctcgtgagtaatgatgcatatctcctaggaagagagaaggcactgagggaatcacaccttgcagagattgatgacctaattgatcttgcagcctcaggagatcccacaccacctgactcaataaaatcaccacaggcaccatgggtgtttgcttgtgcacctgatagatgccccccaacatgtatatatgtggctgggatggctgaattaggagccttcttctcaatcctacaggatatgagaaacacaatcatggcatctaagacagtgggcacagcagaagagaagctgaagaagaagtcctcgttttaccaatcctatttgcggcgcactcaatcgatgggtatacaactggatcaaaggataatattgctgttcatgatggagtgggggtctgatattgtcaatcatttccatctgggtgatgatatggaccctgaactcaggacactagcacagagtctcattgatcagaaggtcaaagagatttcaaatcaggaaccattaaagatataa

SEQ ID NO: 2923 - RNA, 1449 nt, synthetic construct
  misc_feature 1..1449: note = derived and/or modified CDS sequence (wt) from CCHFV(IbAr10200)__NC_005302.1/U88410.1__N
  source 1..1449: mol_type = other RNA
atggaaaacaagatcgaggtgaataacaaagatgagatgaacaggtggtttgaagagttcaaaaaaggaaatggacttgtggacaccttcacaaactcctattccttttgcgagagtgttcccaatttggacaggtttgtgtttcagatggccagtgccaccgatgatgcacagaaggactccatctacgcatctgctctggtggaggcaacaaagttttgtgcacctatatatgagtgcgcatgggttagctccactggcattgtaaaaaagggacttgaatggttcgagaaaaatgcaggaaccattaagtcctgggatgaaagttatactgagctaaaggtcgacgtcccgaaaatagagcagcttaccggttaccaacaagctgccttgaagtggagaaaagacataggtttccgtgtcaatgccaacacagcagctctgagcaacaaagtcctcgcagaatacaaagtccctggtgagattgtgatgtctgtcaaagagatgctgtcagacatgattaggagaaggaacctgattctaaacaggggtggtgatgagaacccacgtggcccagtgagccatgagcatgtagactggtgcagggagtttgtcaaaggcaaatacatcatggccttcaacccaccatggggggacatcaacaagtcaggccgttcaggaatagcacttgttgcaacaggccttgctaagcttgcagagactgaaggaaagggaatatttgatgaagccaaaaagactgtggaggccctcaacgggtatctggacaagcataaggacgaagttgatagagcaagcgccgacagcatgataacaaaccttcttaagcatattgccaaggcacaggagctctataaaaattcatctgcacttcgtgcacaaagcgcacagattgacactgctttcagctcatactattggctttacaaggctggcgtgactcctgaaaccttcccgacggtgtcacagttcctctttgagctagggaaacagccaagaggtaccaagaaaatgaagaaggctcttctgagcaccccaatgaagtgggggaagaagctttatgagctctttgccgatgattctttccagcagaacaggatttacatgcatcctgccgtgcttacagctggtagaatcagtgaaatgggagtctgctttgggacaatccctgtggccaatcctgatgatgctgcccaaggatctggacacactaagtctattctcaacctccgtaccaacactgagaccaataatccgtgtgccaaaaccatcgtcaagctatttgaagttcaaaaaacagggttcaacattcaggacatggacatagtggcctctgagcacttgctacaccaatcccttgttggcaagcaatccccattccagaacgcctacaacgtcaagggcaatgccaccagtgctaacatcatttaa

SEQ ID NO: 2924 - RNA, 1449 nt, synthetic construct
  misc_feature 1..1449: note = derived and/or modified CDS sequence (wt) from CCHFV(Turkey-Kelkit06)__GQ337053.1__N
  source 1..1449: mol_type = other RNA
atggaaaacaagatcgaggtgaacagcaaggatgagatgaacaaatggtttgaggagtttaaaaagggaaatggacttatggacactttcacaaactcctactccttttgtgagaatgtaccaaatctggataagtttgtgttccagatggccagcgccacagatgatgcacagaaggactccatctatgcatcggctctagtggaagcaaccaagttctgtgcacccatatatgaatgtgcttgggtcagctctactggcattgtgaagaaggggcttgagtggttcgagaaggattcaggaactatcaaatcatgggatgagaactatgctgagctgaaggttgatgttcccaaaatagaacaacttgccaattaccaacaggctgctcttaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggggcggtgatgaaaatccacgcggcccagtgagccgtgaacatgtggagtggtgcagggaatttgtcaaaggcaagtacatcatggctttcaatccaccttggggggacatcaacaaatcaggtcgttcgggaatagcacttgttgcaacaggccttgccaagcttgcagagaccgaggggaaaggagtttttgacgaagctaagaagaccgtggaggctctcaatgggtatttggacaagcacagggacgaagtcgacaaagcaagtgctgacagcatgataacaaacctccctaagcacattgccaaagcacaagagctttataaaaattcatctgctcttcgtgcacaaggtgcacagattgacacccctttcagctcgttttactggctctacaaggccggtgtgactccagagaccttcccaaccatctcacagttcctttttgaactgggggagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaagaaacaggatttaacatacaggacatggacattgtggcctctgagcacttgctgcaccaatccattgttggcaagcaatctccattccaaaatgcctacaacgtcaagggcaatgccaccagtgccaacatcatctaa

SEQ ID NO: 2925 - RNA, 1449 nt, synthetic construct
  misc_feature 1..1449: note = derived and/or modified CDS sequence (wt) from CCHFV(Baghdad 12)__AJ538196.1__N
  source 1..1449: mol_type = other RNA
atggaaaacaaaatcgaagtgaacagtaaggatgaaatgaacaagtggtttgaggagttcaagaaggggaatggacttgtggacacttacacaaactcctattctttttgtgaaagtgttccaaatctggatagatttgtatttcagatggctggtgccactgatgatgctcaaaaggactctatctacgcatctgctctggtggaagcaaccaaattttgtgcacctatatacgagtgtgcttgggctagctccactggcattgtcaagaagggactggagtggtttgagaaaaatacaggaactattaaatcttgggatgagagttatactgagctgaaagttgaagttcccaaaatagaacaacttttcaactaccagcaggctgctctcaagtggaggaaagacataggtttccgtgtcaatgcaaacacggcagctttaagtaacaaagtcctagcagaatacaaagttcctggcgaaattgtaatgtctgttaaagagatgttgtcagatatgattagaaggaggaacttgatcctcaacagaggtggtgacgagaacccacgcggcccagtcagccgtgaacatgtggagtggtgtagggaatttgtcaaaggcaagtacataatggctttcaacccaccttggggggacatcaacaagtcaggccgttctggaatagcacttgttgcaacaggccttgccaagcttgcagagactgaagggaaaggagtctttgacgaagccaagaagactgtggaagctctcaacgggtatctagacaagcacaaggacgaagttgacaaagcaagtgccgacaacatggtaacaaaccttcttaagcatgtcgctaaggcacaagagctttacaaaaactcttctgctcttcgtgcacagggtgcacagattgatactgtcttcagctcatactactggctttacaaggctggtgtgactccagaaaccttcccaactgtctcacagttccttttcgagttagggaagcatccaaggggtaccaagaaaatgaagaaggcactcctgagtaccccaatgaagtggggaaagaagctttatgagctttttgccgatgattctttccagcagaacaggatctacatgcatcccgctgtgctgacagccggaagaatcagtgaaatgggtgtctgctttggaacaatcccggtggccaatcctgatgatgctgccttaggatctggacacaccaagtccattctcaaccttcggacaaacactgagaccaacaatccatgtgccagaacaattgttaagttgtttgaaattcagaaaacagggtttaacatacagcacatggacattgtggcctctgagcacctactgcaccaatcccttgttggcaagcagtctccatttcaaaatgcctacaacgtcaaggggaatgccaccagcgccaacatcatctaa

SEQ ID NO: 2926 - RNA, 1449 nt, synthetic construct
  misc_feature 1..1449: note = derived and/or modified CDS sequence (wt) from CCHFV(SR3)__AJ538198.1__N
  source 1..1449: mol_type = other RNA
atggaaaacaaaatcgaggtgaacagcaaagatgagatgaacaagtggtttgaggagttcaagaaaggaaatggacttgtggacaccttcacaaactcctattccttttgtgaaagcgttccaaatctggacagatttgtattccagatggctagtgccactgatgatgcacaaaaggattccatctacgcatctgctctggtggaggcaaccaaattttgtgcacctatatacgaatgtgcctgggctagctccactggcattgttaagaagggactggagtggttcgaaaaaaatgcaggaaccattaaatcatgggatgaaagttatactgagctgaaagttgaggttcccaaaatagaacagctttccaactaccagcaggctgctctcaagtggaggaaagacataggcttccgtgtcaatgcaaacacagcagctttgagcaacaaggtccttgcagagtacaaggttcctggcgaaattgtaatgtctgtcaaagagatgttgtcagatatgattaggagaaggaacctgattctcaacagaggtggtgatgaaaacccacgcggcccagtcagccgtgaacatgtggaatggtgtagggaatttgtcaaaggcaagtacataatggctttcaacccaccttggggggacatcaataagtcaggccgttcaggaatagcacttgttgcaacaggccttgccaagcttgcagagactgaagggaagggagtttttgacgaagccaagaaaactgtagaggctctcaacgggtatctggacaagcataaggacgaggttgacaaagcaagtgctgacagcatgataacaaaccttctcaagcatattgctaaagcacaggagctttacaaaaactcgtctgctctccgtgcacagggtgcacagattgataccgtcttcagctcgtactactggctctacaaggccggcgtgactccagatactttcccggctgtctcacagttcctttttgagttggggaagcagccaaggggtaccaagaaaatgaagaaggcactcttgagcaccccaatgaagtgggggaagaagctttatgagcttttcgccgatgattctttccagcagaacaggatctacatgcaccctgctgtgctgacagctggcagaatcagtgaaatgggtgtctgctttggaacaatccctgtggccaatcctgatgatgctgccttaggatctgggcacaccaagtccattctcaaccttcggacaaacactgagaccaacaatccatgtgccaagacaattgttaagttgtttgaaattcagaaaacagggttcaacatacaggacatggacattgtggcctctgagcacctactgcaccaatcccttgttggcaagcagtctccatttcaaaatgcctacaacgtcaaggggaacgccaccagtgccaacatcatctaa

SEQ ID NO: 2927 - RNA, 1449 nt, synthetic construct
  misc_feature 1..1449: note = derived and/or modified CDS sequence (wt) from CCHFV(Gaib)__KX013446.1__N
  source 1..1449: mol_type = other RNA
atggagaataaaatcgaggtgaacaacaaagatgagatgaacaagtggtttgaagagttcaagaaaggaaatggacttgtggacactttcacaaactcctactccttttgtgagagtgttccaaatctggacagatttgtatttcagatggccagtgctactgatgatgcacaaaaggattccatctatgcatcagctctagtggaggcaaccaaattttgcgcacccatatacgagtgtgcctgggttagctccactggtattgtgaagaagggactggagtggttcgaaaaaaatgcaggaaccattaaatcttgggatgaaagctacactgagctgaaagttgaggtccctaaaatagagcagcttgccaattaccaacaggctgctctaaagtggagaaaggacataggtttccgtgtcaatgcaaatacggcagccttaagccataaggtccttgcagaatacaaagtccctggtgaaattgtaatgtctgtcaaagaaatgttgtcagatatgattagaaggaggaacttaattctcaacagaggtggcgatgaaaatccacgaggcccggtgagccgtgaacatgtggaatggtgcagggagtttgtcaaaggcaagtacattatggctttcaacccaccttggggcgacatcaacaagtcaggtcggtcaggaatagcacttgttgcaacaggccttgccaagcttgcagagactgaagggaaaggagtgttcgatgaagcaaaaaagactgtagaggctctcaacgggtacctggacaagcataaggacgaggttgacaaagcaagtgccgacaacatgataacaaaccttctcaaacacatcgccaaggcacaggagctttacaaaaactcgtctgcacttcgtgcacagggtgcacagattgacactgctttcagctcatactactggctctacaaggccggcgtgactccggaaaccttcccaactgtctcacagttcctgtttgaactagggaagcaaccaaggggtaccaagaaaatgaagaaggcactcttgagcactccaatgaagtgggggaagaagctctatgagctctttgctgatgattctttccagcagaacaggatctacatgcaccctgctgtgttgacagccggcagaatcagtgagatgggtgtctgctttggaacaatccctgtggccaatcctgatgatgccgcccagggatccggacacaccaagtccattcttaatcttcgaacaaacaccgaaaccaacaatccgtgtgccaagacaattgtcaagttgtttgaaattcaaaaaacagggtttaacatacaagacatggacattgtagcctctgagcatctgctgcaccagtctcttgtcggcaagcagtctccattccaaaatgcctacaatgtcaagggcaacgctacaagtgccaacatcatctaa

SEQ ID NO: 2928 - RNA, 1449 nt, synthetic construct
  misc_feature 1..1449: note = derived and/or modified CDS sequence (wt) from CCHFV(Hodzha)__KX013449.1__N
  source 1..1449: mol_type = other RNA
atggagaataaaatcgaggtgaacaacaaagatgagatgaacaagtggtttgaagagttcaaaaaaggaaatggacttgtggacactttcacaaactcctactccttttgtgagagtgttccaaatctggacagatttgtatttcagatggccagtgctactgatgatgcacaaaaggattccatctacgcatctgctctagtggaggcaaccaaattttgcgcacccatatacgagtgtgcctgggttagctccactggtattgtgaagaagggactggagtggttcgagaaaaatgcgggaaccattaagtcttgggatgaaagctacactgagctgaaagttgaggtccctaaaatagagcagcttgccaattaccaacaggctgctctaaagtggagaaaggacataggtttctgtgttaatgcaaatacggcggccttaagccaaaaggtcctttcagaatacaaagtccctggtgaaattgtaatgtctgtcaaagaaatgttgtcagatatgattagaaggaggaacttaattctcaacagaggtggcgatgaaaatccacgaggcccggtgagccgtgaacatgtggagtggtgcagggagtttgtcaaaggcaagtacatcatggctttcaacccaccttggggcgatatcaacaagtcaggtcggtcaggaatagcacttgttgcaacaggccttgccaaacttgcagagactgaagggaaaggagtgtttgatgaagcaaaaaagactgtggaggctctcaacgggtacctggacaagcataaggacgaggttgacaaagcaagtgccgacaacatgacaacaaaccttcttaaacacatcgccaaggcacaggagctttacaaaaactcgtctgcacttcgtgcacagggtgcacagattgacactgctttcagctcatactactggctctataaggccggcgtgaccccagaaaccttcccaactgtctcacagttccttttcgaattagggaagcaaccaaggggtaccaagaaaatgaagaaggcactcttgagcactccaatgaagtgggggaagaagctctatgagctctttgctgatgattctttccagcagaacaggatctacatgcaccctgctgtgttgacaaccggcagaatcagtgagatgggtgtctgctttggaacagtccctgtggccgatcctgatgatgccgcccagggatccggacacaccaagtccattcttaatcttcgaacaaacaccgagaccaacaatccgtgtgccaagacaattgtcaagttgtttgaaattcaaaaaacagggtttaacatacaggacatggacattgtagcctctgagcacctgctgcaccagtctcttgtcggcaagcagtctccgttccaaaatgcctacaatgtcaagggcaacgctacaagtgccaacatcatctaa

SEQ ID NO: 2929 - RNA, 1449 nt, synthetic construct
  misc_feature 1..1449: note = derived and/or modified CDS sequence (wt) from CCHFV(IbAn7620)__KX013452.1__N
  source 1..1449: mol_type = other RNA
atggagaacaaaatcgaggtgaataacaaagatgagatgaataggtggtttgaagagttcaagaaagagaatgggctagtagatactttcacaaactctcattccttctgtgaaagtgtcccaaatctggacaaatttgtgttccagatggctagtgccaccgatgatgcacaaaaggattccatctatgcagctgcactggtggaggcaaccaaattctgtgcacctatatacgagtgtgcttgggttagctccactggcatcgtcaagaaggggctagaatggtttgaaaaaaatgcaggaaccattaaatcttgggatgagagttataccgagttgaaggttgaagttcccaaaatagaacagctatctaattaccagcaggctgctctcaagtggaggaaggacataggcttccgtgtcaatgcaaatacggcaaccctgagccataaagtccttgcagagtataaagtacctggtgagattgtgatgtctgtcaaagaaatgttatcagacatgatcagaaggagaaatctgattctcaacagaggtggtgatgagaacccacgtggcccagtgagccgtgaacatgtggaatggtgcagggaatttgttaaaggcaagtacataatggcctttaaccctccctggggggacatcaacaagtcaggacgttcaggaatagcactagttgcaacaggccttgccaagcttgcagaggctgaagggaagggagtgtttgatgaagctaagaagactgtagaggctcttaacggatatctagacaaacataaggacgaagttgacaaatcaagtgctgacagcatgataacaaaccttctcaagcacattgcaaaggcgcaggagctctataagaattcttctgcacttcgtgcacagggtgcacagattgacactgctttcagctcatattactggctctacaaggcaggtgtgactccagaaaccttcccaactgtctcacagttccttttcgagctggggaagcaaccaaggggcactaagaaaatgaagaaggcactcttgagcacaccaatgaagtgggggaagaagctttatgagctctttgctgatgattctttccagcagaacaggatttacatgcaccctgctgtgctaacagctggcagaatcagtgagatgggtgtctgctttgggacaatccctgtggccaatccagatgatgctgccctagggtctggacataccaagtctattcttaatcttcgaacaagcactgaggccaacaatccatgtgctaagacaattgtcaagttgtttgagattcagaaaaaaggatttgtaataaaagatatggacattgtggcctctgagcatctgctacaccaatcccttgttggtaagcagtctccattccagaatgcttataatgtcaagggtaacgccaccagtgctaacatcatctaa

SEQ ID NO: 2930 - RNA, 1449 nt, synthetic construct
  misc_feature 1..1449: note = derived and/or modified CDS sequence (wt) from CCHFV(K128_76)__KX013455.1__N
  source 1..1449: mol_type = other RNA
atggagaataaaatcgaggtgaataacaaagatgagatgaacaagtggtttgaagagttcaagaaaggaaatggacttgtggacactttcacaaactcctactccttttgtgagagtgttccaagtctggacaggtttgtgtttcagatggccagtgccaccgacgatgcacaaaaggattccatctacgcgtcagctctggtggaagcaaccaaattttgtgcacccatatacgagtgtgcctgggttagctccactggcattgtgaagaagggactggagtggttcgaaaagaatgcaggaaccattaaatcttgggatgaaagctacactgagctgaaagttgaggtccccaaaatagaacagcttgccaattaccaacaggctgctctcaagtggaggaaggacataggttttcgtgtcaatgcaaatacggcagccttaagccacaaagtcctcgcagagtacaaagtccctggtgaaattgtaatgtctgtcaaagaaatgttgtcagatatgattagaagaaggaacttgattctcaacagaggtggcgatgaaaacccgcgaggcccagtgagccgtgaacatgtggagtggtgcagagaatttgtcaaaggcaagtacatcatggctttcaacccgccctggggggacatcaacaagtcaggccgatcaggaatagcacttgttgcaacaggccttgccaagctcgcagagactgaggggaagggagtgtttgatgaagcaaaaaagactgtagaggctctcaacggatacctggacaaacacaaggacgaagttgacaaagcaagtgccgacaacatgataacaaaccttctcaaacacattgccaaggcacaggagctttacaaaaactcgtctgcacttcgtgcacagggtgcacagattgacaccgctttcagctcatactactggctctacaaggccggcgtgactccagaaaccttcccgactgtctcacagttccttttcgaactagggaaacaaccaaggggtaccaagaaaatgaagaaggcactcttgagcaccccaatgaagtgggggaagaagctttatgagctttttgctgatgactctttccagcaaaacaggatctacatgcaccctgccgtgttgacagccggcagaatcagtgagatgggtgtctgctttggaacaatccctgtggccaatcccgatgatgctgcccagggatctggacacaccaagtccatccttaacctacggacaaacaccgagaccaacaatccgtgtgccaagacaattgtcaagttgtttgaaattcaaaaaacagggttcaatatacaagacatggatattgtagcctctgaacacctgttgcaccagtcccttgttggcaagcagtctccattccagaatgcctacaatgtcaagggcaatgccaccagtgccaacatcatctaa

SEQ ID NO: 2931 - RNA, 1449 nt, synthetic construct
  misc_feature 1..1449: note = derived and/or modified CDS sequence (wt) from CCHFV(K168_125)__KX013461.1__N
  source 1..1449: mol_type = other RNA
atggagaataaaatcgaggtgaacaacaaagatgagatgaacaagtggtttgaagagttcaagaaaggaaacggacttgtggacactttcacaaactcctactccttttgtgagagtgttccaaatctggatagatttgtattccagatggctagtgccactgatgatgcacaaaaggattccatctacgcatcagctctagtggaagcaaccaaattctgtgcacccatatatgagtgtgcctgggttagctccactggcattgtgaagaagggactggagtggttcgagaaaaatgcaggaaccattaaatcttgggatgaaagctatactgagctgaaagttgaggtccctaaaatagagcagcttgctaattaccaacaggccgctctcaagtggagaaaggacataggtttccgtgtcaatgcaaatacggcagccttaagccacaaagtcctcgcagagtacaaagtccctggtgatattgtaatgtctgtcaaagaaatgttgtcagatatgattagaaggaggaacttaattctcaacagaggtggcgatgaaaatccacgaggcccggtgagccgtgaacatgtggaatggtgcagggaatttgtcaaaggcaagtacatcatggctttcaacccgccttggggcgacatcaacaagtcaggccgatcaggaatagcacttgttgcaacaggccttgccaagcttgcagagactgaagggaagggagtgtttgatgaagcaaaaaagactgtagaggctctcaacgggtacctggacaaacataaggacgaggttgacaaggcgagtgccgacaacatgataacaaaccttctcaaacacattgccaaggcacaggagctttacaaaaactcgtctgcacttcgtgcacagggtgcacagattgacactgctttcagctcatactactggctctacaaggccggcgtgacttcagaaaccttcccgactgtctcacaattcctcttcgaactagggaaacaaccaaggggtacaaagaaaatgaagaaggcactcttgagcactccaatgaagtgggggaagaagctttatgagctctttgctgatgattcttttcagcagaacaggatctacatgcaccctgctgtgctgacagccggcagaattagtgagatgggtgtctgctttggaacaatccctgtggccaatcctgatgacgctgcccagggatccggacacaccaagtccattcttaatcttcgaacaaacaccgagaccaacaatccgtgtgccaagacgattgtcaagttgtttgaaattcaaaaaacagggtttaacatacaggacatggacattgtggcctctgagcacctgctgcaccagtctcttgtcggcaagcagtctccattccaaaatgcctacaatgtcaagggcaacgctaccagtgccaacatcatctaa

SEQ ID NO: 2932 - RNA, 1449 nt, synthetic construct
  misc_feature 1..1449: note = derived and/or modified CDS sequence (wt) from CCHFV(K168_40)__KX013458.1__N
  source 1..1449: mol_type = other RNA
atggagaataaaatcgaggtgaacaacaaagatgagatgaacaagtggtttgaagagttcaagaaaggaaacggacttgtggacactttcacaaactcctactccttttgtgagagtgttccaaatctggatagatttgtattccagatggctagtgccactgatgatgcacaaaaggattccatctacgcatcagctctagtggaagcaaccaaattctgtgcacccatatatgagtgtgcctgggttagctccactggcattgtgaagaagggactggagtggttcgagaaaaatgcaggaaccattaaatcttgggatgaaagctatactgagctgaaagttgaggtccctaaaatagagcagcttgctaattaccaacaggccgctctcaagtggagaaaggacataggtttccgtgtcaatgcaaatacggcagccttaagccacaaagtcctcgcagagtacaaagtccctggtgatattgtaatgtctgtcaaagaaatgttgtcagatatgattagaaggaggaacttaattctcaacagaggtggcgatgaaaatccacgaggcccggtgagccgtgaacacgtggaatggtgcagggaatttgtcaaaggcaattacatcatggctttcaacccgccttggggcgacatcaacaagtcaggccgatcaggaatagcacttgttgcaacaggccttgccaagcttgcagagactgaagggaagggagtgtttgatgaagcaaaaaagactgtagaggctctcaacgggtacctggacaaacataaggacgaggttgacaaggcgagtgccgacaacatgataacaaaccttctcaaacacattgccaaggcacaggagctttacaaaaactcgtctgcacttcgtgcacagggtgcacagattgacactgctttcagctcatactactggctctacaaggccggcgtgacttcagaaaccttcccgactgtctcacaattcctcttcgaactagggaaacaaccaaggggtacaaagaaaatgaagaaggcactcttgagcactccaatgaagtgggggaagaagctttatgagctctttgctgatgattcttttcagcagaacaggatctacatgcaccctgctgtgctgacagccggcagaattagtgagatgggtgtctgctttggaacaatccctgtggccaatcctgatgacgctgcccagggatccggacacaccaagtccattcttaatcttcgaacaaacaccgagaccaacaatccgtgtgccaagacgattgtcaagttgtttgaaattcaaaaaacagggtttaacatacaggacatggacattgtggcctctgagcacctgctgcaccagtctcttgtcggcaagcagtctccattccaaaatgcctacaatgtcaagggcaacgctaccagtgccaacatcatctaa

SEQ ID NO: 2933 - RNA, 1449 nt, synthetic construct
  misc_feature 1..1449: note = derived and/or modified CDS sequence (wt) from CCHFV(K323_27)__KX013473.1__N
  source 1..1449: mol_type = other RNA
atggaaaacaagatcgaggtgaacagcaaagatgagatgaacaaatggtttgaagagtttaaaaagggaaatggacttatggatactttcacaaactcctactccttttgtgagaatgtaccaaatctggataagtttgtgttccagatggccagcgccactgatgatgcacagaaggactccatctatgcatcggctctggtggaagcaaccaaattctgtgcacccatatatgaatgtgcttgggtcagctctaccggcattgtgaagaaggggcttgagtggttcgagaagaattcaggaaccatcaaatcctgggatgagaactatgctgaactgaaggttgatgttcccaaaatagaacaacttgccaattaccaacaggctgctctcaagtggaggaaggacataggtttccgtgtcaatgcaaacacggcagccttaagcaacaaggtccttgcagaatacaaagtccctggcgaaattgtgatgtctgttaaagaaatgctgtcagacatgattagaaggaggaatctaattctcaataggggcggtgatgaaaatccgcgcggcccagtgagccgtgaacatgtggagtggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagccaagaagaccgtggaggctctcaatgggtatttggacaagcacagagacgaagttgacaaagcaagtgctgacagcatgataacaaacctcctgaagcacattgccaaagcacaagagctttataaaaattcatctgctcttcgtgcacaaggtgcacagattgacactcctttcagctcgttttactggctttacaaggccggtgtgactccagagaccttcccaactatctcacagttccttttcgaactagggaagcaaccaagggggaccaagaaaatgaaaaaagcactcctgagcactccaatgaagtgggggaagaaactttatgagctctttgctgatgactctttccagcagaacagaatctacatgcaccctgctgtgttgacagccggcagaatcagtgaaatgggtgtctgctttggaacaatccctgttgccaatcctgatgacgctgctcagggatctggacataccaagtccattctcaaccttcggacaagcacagagaccaacaatccatgcgccaagacaattgtcaaattgtttgaaatccaaaaaacaggatttaacatacaggacatggacattgtagcctctgagcacctgcttcaccaatcccttgttggcaagcagtctccattccaaaatgcctttaacgtcaagggcaatgccaccagtgccaacatcatctaa

SEQ ID NO: 2934 - RNA, 1449 nt, synthetic construct
  misc_feature 1..1449: note = derived and/or modified CDS sequence (wt) from CCHFV(Min)__KX013482.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagcgccactgatgatgcacagaaggactccatctatgcatcggctctggtggaagcaaccaagttctgtgcacccatatatgaatgtgcctgggtcagctctaccggcattgtgaagaaggggcttgagtggttcgagaagaattcaggaaccatcaaatcctgggatgagaactatgctgagctgaaggttgatgttcccaaaatagaacaacttgccaattaccagcaggctgctctcaagtggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatctaattctcaacaggggcggtgatgaaaatccgcgcggcccagtgagccgtgaacatgtggagtggtgcagggaatttgtcaaaggcaagtacatcatggccttcaatccaccttggggggacatcaacaaattaggccgttcgggaatagcacttgttgcaacaggccttgccaagcttgcagagaccgaggggaaaggagtttttgacgaagccaagaagaccgtggaggctctcaatgggtatttggacaagcacagggacgaagttgacaaagcaagtgctgacagcatgataacaaacctcctgaagcacattgccaaagcacaagagctttataaaaattcatctgctcttcgtgcacaaggtgcacagattgacacccctttcagctcgttttactggctttacaaggccggtgtgactccagagaccttcccaactatctcacagttccttttcgaactggggaagcaaccaagggggaccaagaaaatgaaaaaggcactcctgagcactccaatgaagtgggggaagaaactttatgagctctttgctgatgactctttccagcagaacagaatctacatgcaccctgctgttttaacagccggtagaatcagtgaaatgggtgtctgctttggaacaatccctgttgccaatcctgatgacgctgctcagggatctggacataccaagtccattctcaaccttcggacaagcacagagaccaacaatccatgcgccaagacaattgtcaaattgtttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 2935 - RNA, 1449 nt, synthetic construct
  misc_feature 1..1449: note = derived and/or modified CDS sequence (wt) from CCHFV(Saf)__KX013488.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagcgccactgatgatgcacagaaggactccatctatgcatcggctctggtggaagcaaccaagttctgtgcacccatatatgaatgtgcctgggtcagctctacaggcattgtgaagaaggggcttgagtggttcgagaagaattcaggaaccatcaaatcctgggatgagaactatgctgagctgaaggttgatgttcccaaaatagaacaacttgccaattaccagcaggctgctctcaagtggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatctaattctcaacaggggcggtgatgaaaatccgcgcggcccagtgagccgtgaacatgtggagtggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagccaagaagaccgtggaggctctcaatgggtatttggacaagcacagggacgaagttgacaaagcaagtgctgacagcatgataacaaacctcctgaagcacattgccaaagcacaagagctttataaaaattcatctgctcttcgtgcacaaggtgcacagattgacacccctttcagctcgttttactggctttacaaggccggtgtgactccagagaccttcccaactatctcacagttccttttcgaactggggaagcaaccaagggggaccaagaaaatgaaaaaggcactcctgagcactccaatgaagtgggggaagaaactttatgagctctttgctgatgactctttccagcagaacagaatctacatgcaccctgctgtgttaacagccggtagaatcagtgaaatgggtgtctgctttggaacaatccctgttgccgatcctgatgacgctgctcagggatctggacataccaagtccattctcaaccttcggacaagcacagagaccaacaatccatgcgccaggacaattgtcaaattgtttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 2936 - RNA, 1449 nt, synthetic construct
  misc_feature 1..1449: note = derived and/or modified CDS sequence (wt) from CCHFV(UCCR4459)__KY484031.1__N
  source 1..1449: mol_type = other RNA
atggagaataaaatcgaggtgaataacaaagatgagatgaacaagtggtttgaagagttcaagaaaggaaatggacttgtggacactttcacaaactcctactccttttgtgagagtgttccaaacctggacaggtttgtgtttcagatggccagtgccaccgatgatgcacaaaaagattccatctacgcatcagctctggtggaagcaaccaaattttgtgcacccatatacgagtgtgcctgggttagttccactggcattgtgaagaaggggctggagtggttcgaaaaaaatgcaggaaccattaaatcttgggatgaaagctacacggagctgaaagttgaagtccctaaaatagaacagcttgccggctaccaacaggctgctctcaagtggaggaaggacataggttttcgtgtcaatgcaaatacggcagccttaagccacaaagtcctcgcagagtacaaagtccctggtgaaatcgtaatgtctgtcaaagagatgttatcagatatgattagaagaaggaacttgattctcaacagaggtggcgatgaaaacccacgaggcccagtgagccgtgaacatgtggagtggtgcagggaatttgtcaaaggcaagtacatcatggctttcaacccgccttggggggacatcaacaagttaggccgatcaggaatagcacttgttgcaacaggccttgccaagctcgcagagactgaggggaagggagtgtttgatgaagcaaaaaagactgtagaggctctcaacgggtaccttgacaaacacaaggacgaagttgacaaagcaagtgccgacaacatgataacaaaccttctcaaacacattgctaaggcacaagagctttacaaaaactcgtctgcactacgtgcacagggtgcacagattgacactgctttcagctcatactactggctctacaaggcaggcgtgactccagaaactttcccgactgtttcacagttccttttcgagctagggaaacaaccaaggggtaccaagaaaatgaagaaggcactcctgagcaccccaatgaagtgggggaagaagctttatgaactctttgctgatgactctttccagcaaaacaggatctacatgcaccctgccgtgttgacagccggcagaatcagtgagatgggtgtctgctttggaacaatccctgtggccaatcccgatgatgctgcccagggatctggacacaccaagtccattcttaacctacggacaaacaccgaaaccaacaatccgtgtgccaagacaattgtcaagttgtttgaaattcaaaaaacagggtttaacatacaagacatggacattgtagcctctgagcacctgctgcaccaatcccttgtcggcaagcagtctccattccagaatgcctacaacgtcaagggcaatgccaccagtgccaacatcatctaa

SEQ ID NO: 2937 - RNA, 1449 nt, synthetic construct
  misc_feature 1..1449: note = derived and/or modified CDS sequence (wt) from CCHFV(YL16070)__KY354080.1__N
  source 1..1449: mol_type = other RNA
atggagaacaaaatcgaggtgaataacaaagatgagatgaataagtggtttgaagagttcaagaaaggaaatggacttgtggacactttcacaaactcctactctttttgtgagagtgttccaaatctggacagatttgtatttcagatggccagtgccactgatgatgcacaaaaggattccatctacgcatcagctctggtggaagcaactaagttttgcgcacccatatacgagtgtgcctgggttagctccactggtattgtgaagaagggattggagtggttcgaaaaaaatgcaggaaccattaaatcttgggatgaaagctacactgagctgaaagtcgaggttcccaaaatagaacagctcgccgattaccaacaggctgctctcaagtggaggaaggacataggtttccgtgttaatgcaaatacgacagccttaagccacaaagtcctcgcagagtacaaagtccctggtgaaattgttatgtctgtcaaagaaatgttgtcagatatgattagaagaaggaacctgattctcaacagaggtggcgatgaaaatccacgaggcccagtgagccgtgaacatgtggagtggtgcagggaatttgtcaaaggcaagtacatcatggctttcaacccgccttggggggacattaacaagtcaggccggtcaggaatagcacttgttgcaacaggccttgccaagcttgcagagactgaggggaagggagtgtttgatgaagcaaaaaagactgtggaggctctcaacgggtacttgaacaaacataaggacgaggttgacaaagcaagtgctgacagcatgataacaaaccttcttaaacacattgccaaggcacaggagctttacaaaaactcgtccgcacttcgtgcacagggtgcacagattgacactgctttcagctcatactactggctctacaaggccggcgtgactccagaaaccttcccgactgtctcacagtttctttttgaactagggaagcaaccaaggggtaccaagaaaatgaagaaggcactcttgagcaccccattgaaatgggggaagaggctttatgagctctttgctgatgattctttccagcagaacaggatctacatgcaccctgctgtgctaacagccggcagaattagtgagatgggtgtctgctttgggacaatccctgtggccaaccctgatgatgctgcccagggatctggacacaccaagtccattcttaaccttcggacaaacaccgagaccaacaatccgtgtgccaagacaattgtcaagttgtttgaaattcaaaaaacagggttcaacatacaagacatggacattgtagcctctgagcacctgctacaccaatcccttgtcggcaaacagtctccattccaaaatgcctacaatgtcaagggcaacgccaccagtgccaacatcatctaa

SEQ ID NO: 2938 - RNA, 1449 nt, synthetic construct
  misc_feature 1..1449: note = derived and/or modified CDS sequence (wt) from CCHFV(66019)__AJ010648.1__N
  source 1..1449: mol_type = other RNA
atggagaataaaatcgaggtgaataacaaagatgagatgaacaggtggtttgaagagttcaagaaaggaaatggacttgtggacactttcacaaactcctactccttttgtgagagtgttccaaacctggacaggtttgtgtttcagatggccagtgccaccgatgatgcacaaaaggattccatctacgcatcagctctagtggaagcaaccaaattttgtgcacccatatacgagtgtgcctgggttagttccactggcattgtgaagaaggggctggagtggttcgaaaaaaatgcaggaaccattaaatcttgggatgaaagctacacggagctgaaagttgaagtccctaaaatagaacagcttgccagctaccaacaggctgctctcaagtggaggaaggacataggttttcgtgtcaatgcaaatacggcagccttaagccacaaagtcctcgcagagtacaaagtccctggtgaaatcgtaatgtctgtcaaagaaatgttatcagatatgattagaagaaggaacttgattctcaacagaggtggcgatgaaaacccacgaggcccagtgagccgtgagcatgtggagtggtgcagggaatttgtcaaaggcaagtacatcatggctttcaacccgccttggggggacatcaacaagtcaggccgatcaggaatagcacttgttgcaacaggccttgccaagctcgcagagactgaggggaagggagtgtttgatgaagccaaaaagactgtagaggctctcaacgggtaccttgacaaacacaaggacgaagttgacaaagcaagtgccgacaacatgacaacaaaccttctcaaacacattgctaaggcacaagagctttacaaaaactcgtctgcactacgtgcacagggtgcacagattgacactgctttcagctcatactactggctctacaaggcaggcgtgactccagaaaccttcccaactgtttcacagttccttttcgagctagggaaacaaccaaggggtaccaagaaaatgaagaaggcactcttgagcaccccaatgaagtgggggaagaagctttatgagctctttgccgatgactctttccagcaaaacaggatctacatgcaccctgccgtgttgacagccggcagaatcagtgagatgggtgtctgctttggaacaatccctgtggccgatcccgatgatgctgcccaaggatctggacacaccaagtccattcttaacctacggacaaacaccgaaaccaacaatccgtgtgccaagacaattgtcaagttgtttgaaattcaaaaaacagggtttaacatacaagacatggacattgtagcctctgagcacctgctgcaccaatcccttgtcggcaagcagtctccattccagaatgcctacaacgtcaagggcaatgccaccagtgccaacatcatctaa

SEQ ID NO: 2939 - RNA, 1449 nt, synthetic construct
  misc_feature 1..1449: note = derived and/or modified CDS sequence (wt) from CCHFV(8402)__AJ010649.1__N
  source 1..1449: mol_type = other RNA
atggagaataaaatcgaggtgaataacaaagatgaaatgaacaagtggtttgaagagttcaagaaaggaaatggacttgtggatactttcacaaactcctactccttttgtgagagtgttccaaatctggaaaggtttgtgtttcagatggccagtgccaccgatgacgcacaaaaggattccatctacgcatcagctctagtggaagcaaccaaattttgtgcacccatatacgagtgtgcctgggttagctccactggcattgtgaagaagggactggagtggttcgaaaagaatgcaggaaccattaaatcttgggatgaaagctacactgagctgaaagttgaggtccctaaaatagaacagcttgccaattaccaacaggctgctctcaagtggaggaaggacataggttttcgtgtcaatgcaaatacggcagccttaagccacaaggtccttgcagagtacaaagtccctggcgaaattgtaatgtccgtcaaagaaatgttgtcagatatgatcagaagaaggaacttgattctcaacagaggtggcgatgaaaatccacgaggcccagtgagccgtgaacatgtggagtggtgcagggaatttgtcaaaggcaagtacatcatggctttcaacccgccctggggggacatcaacaagtcaggccgatcaggaatagcacttgttgcaacaggccttgccaagctcgcagagactgaggggaagggagtgtttgatgaagccaaaaagactgtagaggctctcaacgggtaccttgacaaacacaaggacgaagttgacaaagcaagtgccgacaacatgataacaaaccttttcaaacacattgctaaggcacaagagctttacaaaaacttgtctgcacttggtgcacagggtgcacagattgacactgctttcagctcatactactggctctacaaggccggcgtgactccagaaaccttcccgactgtctcacagttcctttttgagctagggaaacaaccaaggggtaccaagaaaatgaagaaggcacttttgagcaccccaatgaagtggggtaagaagctttatgagctctttgctgatgactcattccagcaaaacaggatctacatgcaccctgccgtgttgacggctggcagaatcagtgaaatgggtgtctgctttggaacaatccctgtggccaatcccgatgatgctgcccagggatctggacacaccaagtccattcttaacctacggacaaacaccgaaaccaacaatccgtgtgccaagacaattgtcaagttgtttgaaattcaaaaaacaggatttaatatacaagacatggacattgtagcctctgagcacctgctgcaccaatcccttgtcggcaagcagtctccattccagaatgcctacaacgtcaagggcaatgccaccagtgccaacatcatctga

SEQ ID NO: 2940 - RNA, 1449 nt, synthetic construct
  misc_feature 1..1449: note = derived and/or modified CDS sequence (wt) from CCHFV(Bul/HU517)__AY277676.2__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagcgccactgatgatgcacagaaggactctatctatgcatcggctctagtggaagcaaccaagttctgtgcacccatatatgaatgtgcttgggtcagctccactggcattgtgaagaaggggcttgagtggttcgagaagaattcaggagccatcaaatcttgggatgagaactatgttgagctgaaggttgatgttcccaaaatagaacaacttgccaattaccaacaggctgctctcaagtggaggaaggacataggtttccgtgtcaatgcaaacacggcagccttaagcaacaaagtccttgcagaatataaagtccctggcgaaattgtgatgtctgttaaagaaatgctgtcagacatgattagaaggaggaatctaattctcaacaggggcagtgatgaaaatccacgcggcccagtgagccatgaacatgtggaatggtgcagagaatttgtcaaaggcaagtatatcatggccttcaatccaccttggggagacattaacaaatcaggtcgttcgggaatagcacttgttgcaacaggccttgccaagcttgcagagaccgaggggaaaggagtttttgacgaagctaagaagaccgtggaggctctcaatgggtatttggacaagcacagggacgaagttgacaaagcaagtgctgacagcatgataacaaacctcctaaagcacattgccaaagcacaagagctttataaaaattcatctgctcttcgtgcacaaggtgcacagattgacacccctttcagctcattttactggctctacaaagccggtgtgactccagagactttcccaaccatctcacagttccttttcgaactggggaagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaaaaaacaggatttaacatacaggacatggacattgtagcctctgagcacctgctgcaccaatcccttgtcggcaagcaatctccattccagaatgcttacaacgtcaagggcaatgccaccagtgccaacatcatctaa

SEQ ID NO: 2941 - RNA, 1449 nt, synthetic construct
  misc_feature 1..1449: note = derived and/or modified CDS sequence (wt) from CCHFV(V46/13)__KR011837.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagcgccactgatgatgcacagaaggactccatctatgcatcggctctagtggaagcaaccaaattctgtgcacccatatatgaatgtgcttgggtcagctctactggcattgtgaagaaggggcttgagtggtttgagaagaattcaggaaccatcaaatcttgggatgagaactatgctgagctgaaggttgatgttcccaaaatagaacaacttgccaattaccaacaggctgctctcaagtggaggaaggacataggtttccgtgtcaatgcaaacacggcagccttaagcaacaaagtccttgcagaatataaagtccctggcgaaattgtgatgtctgttaaagaaatgctgtcagacatgattagaaggaggaatctaattctcaacaggggcagtgatgaaaatccacgcggcccagtgagccgtgaacatgtggagtggtgcagggaatttgtcaaaggcaagtacatcatggccttcaatccaccttggggggacatcaacaaatcaggtcgttcgggaatagcacttgttgcaacaggccttgccaagcttgcagagaccgaggggaaaggagtttttgacgaagccaagaaggccgtggaggctctcaatgggtatttggacaagcacagggacgaagttgtcaaagcaagtgctgacagcatgataacaaacctcctaaagcacattgccaaagcacaagagctttataaaaattcatctgctcttcgtgcacaaggtgcacagattgacacccctttcagctcgttttactggctctacaaggccggtgtgactccagagaccttcccaaccatctcacagttccttttcgaactggggaagcagccaagggggaccaaaaaaatgaaaaaagcactcctaagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgcacagggatctggacataccaagtccattctcaaccttcggacaagcacagagaccaacaatccatgcgccaagacaattgtcaaattatttgaaatccaaaaaacaggattcaacatacaggacatggacattgtagcctctgagcacctgctgcaccaatcccttgttggcaagcagtctccattccaaaatgcctacaacgtcaagggcaatgccaccagtgccaacatcatctaa

SEQ ID NO: 2942 - RNA, 1449 nt, synthetic construct
  misc_feature 1..1449: note = derived and/or modified CDS sequence (wt) from CCHFV(1231-CR/TI-2015)__KU161587.1__N
  source 1..1449: mol_type = other RNA
atggaaaacaagatcgaggtgaacagcaaagatgagatgaacaaatggtttgaggagtttaagaagggaaatggacttatggacactttcacaaactcctactccttttgtgagaatgtaccaaatctggacaagtttgtgttccagatggccagcgccactgatgatgcacagaaggactccatctatgcatcggctctggtggaagcaaccaagttctgtgcacccatatatgaatgtgcttgggtcagctccaccggcattgtgaagaaagggcttgagtggttcgagaagaattcagggaccatcaaatcctgggatgagaactatgctgagctgaaggttgatgttcccaaaatagaacaacttgccaattaccaacaggctgctctcaagtggaggaaagacataggtttccgtgtcaatgcaaacacggcagccttaagcaacaaggtccttgcagaatacaaagtccctggcgaaattgtaatgtctgttaaagaaatgctgtcagacatgattagaaggaggaatctaattctcaataggggcggtgatgaaaatccacgcggcccagtgagccgtgaacatgtggagtggtgcagggaatttgtcaaaggcaagtacatcatggccttcaatccaccttggggggacatcaacaaatcaggccgttcaggaatagcacttgttgcaacaggccttgccaagcttgcagagaccgaggggaaaggagtttttgacgaagctaagaagaccgtggaggctctcaatgggtatttggacaagcacagggacgaagttgacaaagcaagtgctgacagcatgataacaaacctcctgaagcacattgccaaagcacaagagctttataaaaattcatctgctcttcgtgcacaaggtgcacagattgacacccctttcagctcattttactggctctacaaggccggtgtgactccagagaccttcccaaccatctcacagttcctttttgaactggggaagcaaccaagggggaccaagaaaatgaaaaaggcactcctgagcactccaatgaagtgggggaagaaactttatgagctctttgctgatgactctttccagcagaacagaatctacatgcaccccgctgtgttgacagccggtagaatcagtgaaatgggtgtctgctttggaacaatccctgttgccaatcctgatgacgctgctcagggatctggacataccaagtccattctcaaccttcggacaagcacagagaccaacaatccatgcgccaagacaattgtcaaattatttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 2943 - RNA, 1449 nt, synthetic construct
  misc_feature 1..1449: note = derived and/or modified CDS sequence (wt) from CCHFV(AP92)__U04958.1__N
  source 1..1449: mol_type = other RNA
atggagaacaaaatcgaggtgaacagcaaagacgatctgaacaagtggtttgaggagttcaagaaaggaaatgggcttgtggacaccttcacaaactcatattctttttgtgaaaatgtgccgaacttggacagatttgtgtatcagatggccagtgcaaccgatgatgcacagaaggactctatatatgcatctgctcttgttgaagcaaccaagtactgtgcaccaatatatgagtgtgcctgggtcagctctacaggcattgtaaagaaaggtttggagtggtttgaaaagaacacgagcactatcaaatcctgggacgagagctacactgagctgaaggttgacattcccaaaatagagcagctctctagttatcagcaggcagccctcaagtggagaaaggacataggtttccgcatcaatgctaacacaacagcgctgagcaacaaagtgcttgcagagtacaaggttccaggagagatcttggtgcctgtcaaagagatgctgtcagacatgataaggagaaggaacattatccttaacagaggcagcgatgagaatccacgaggcccagtaagtcatgagcacattgagtggtgcagggagttcatcaagggaaagtacattatggccttcaatccaccttggggtgacatcaacaaatcaggtcgctccgggattgcacttgtcgcaaccggtcttgccaagctggcagagactgaaggtaaaggagtcttcgaagaagccaaaaagactgtggaagcactcaaggactaccttgacaaacacagagatgaagtcgacaagacaagtgctgacaacatggtgacaagccttttgaaacatattgccaaggctcaggaactctacaagaactcatctgcacttcgtgctcagggtgcacaaattgacactcctttcagctcgttctactggctctacaaggcaggggtcactccagagacgttccccactgtttcccagtttctctttgagcttggaaagcagccaaggggcaccaagaaaatgaagaaagctctgctcagcactcccatgaagtggggaaagaagcactatgagctctttgcagatgactctttccagcagaacaggatctacatgcaccctgctgtgctgacagctggtaggatcagcgaaatgggtgtctgctttgggacaattcctgtagccaacccagatgatgcagcccagggatctggacacaccaagtccattctaaatctaaggacaaacactgagtccaacaatccgtgtgccaggaccattgtcaagcttttcgaaattcagaagacgggctttgacataaaggacatggacatcgtggcctctgagcatctgctgcaccaatccctggttgggaagcagtcgcccttccagaatgcctacaatgtcaagggcaatgccaccagtgccaacatcatctag

SEQ ID NO: 2944 - RNA, 1449 nt, synthetic construct
  misc_feature 1..1449: note = derived and/or modified CDS sequence (wt) from CCHFV(C68031)__M86625.1__N
  source 1..1449: mol_type = other RNA
atggagaataaaatcgaggtgaataacaaagatgaaatgaacaagtggtttgaagagttcaagaaaggaaatggacttgtggatactttcacaaacccctactccttttgtgagagtgttccaaatctggaaaggtttgtgtttcagatggccagtgccaccgatgatgcacaaaaggattccatctacgcatcagctctggtggaagcaaccaaattttgtgcacccatatacgagtgtgcctgggttagctccactggcattgtgaagaagggactggagtggttcgaaaaaaatgcaggaaccattaaatcttgggatgaaagctacattgagctgaaagttgaggtccctaaaatagaacagcttgccaattaccaacaggctgctctcaagtggaggaaggacataggttttcgtgtcaatgcaaatacggcagccttaagccacaaggtccttgcagagtacaaggtccctggcgaaattgtaatgtccgtcaaagaaatgttgtcagatatgattagaagaaggaacttgattctcaacagaggtggcgatgaaaatccacgaggcccagtgagccgtgaacatgtggagtggtgcagggaatttgtcaaaggcaagtacatcatggctttcaacccgccctggggggacatcaacaagtcaggccgatcaggaatagcacttgttgcaacaggccttgccaagctcgcagagactgaggggaagggagtgtttgatgaagccaaaaagactgtagaggctctcaacgggtaccttgacaaacacaaggacgaagttgacaaagcaagtgccgacaacatgataacaaaccttctcaaacacattgctaaggcacaagagctttacaaaaactcgtctgcacttcgtgcacagggtgcacagattgacactgctttcagctcatactactggctctacaaggccggcgtgactccagaaaccttcccgactgtctcacagttcctttttgagctagggaaacaaccaaggggtaccaagaaaatgaagaaggcactcttgagcaccccaatgaagtggggtaagaagctttatgagctctttgctgatgactcattccagcaaaacaggatctacatgcaccctgccgtgttgacagctggcagaatcagtgagatgggtgtctgctttggaacaatccctgtggccaatcccgatgatgctgcccagggatctggacacaccaagtccattcttaacctacggacaaacaccgaaaccaacaatccgtgtgccaagacaattgtcaagttgtttgaaattcaaaaaacaggatttaatatacaagacatggacattgtagcctctgagcacctgctgcaccaatcccttgtcggcaagcagtctccattccagaatgcctacaacgtcaagggcaatgccaccagtgccaacatcatctga

SEQ ID NO: 2945 - RNA, 1449 nt, synthetic construct
  misc_feature 1..1449: note = derived and/or modified CDS sequence (wt) from CCHFV(1-CR/HU-2015)__KU161586.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctagacaagtttgtgtaccagatggccagcgccactgatgatgcacagaaggactccatctatgcatcggctctggtggaagcaaccaagttctgtgcacccatatatgaatgtgcttgggtcagctccaccggcattgtgaagaaagggcttgagtggttcgagaagaattcaggaaccatcaaatcttgggatgagaactatgctgagctgaaggttgatgttcccaaaatagaacaacttgccaattaccaacaggctgctctcaagtggaggaaagacataggtttccgtgtcaatgcaaacacggcagccttaagcaacaaggtccttgcagaatacaaagtccctggcgaaattgtgatgtctgttaaagaaatgctgtcagacatgattagaaggaggaatctaattctcaataggggcggtgatgaaaatccacgcggcccagtgagccgcgaacatgtggagtggtgcagggaatttgtcaaaggcaagtacatcatggccttcaatccaccttggggggacatcaacaaatcaggccgttcaggaatagcacttgttgcaacaggccttgccaagcttgcagagaccgaggggaaaggagtttttgacgaagctaagaagaccgtggaggctctcaatgggtatttggacaagcacagggacgaagttgacaaagcaagtgctgacagcatgacaacaaacctcctgaagcacattgccaaagcacaagagctttataaaaattcatctgctcttcgtgcacaaggtgcacagattgacacccctttcagctcattttactggctctacaaggccggtgtgactccagagaccttcccaaccatctcacagttcctttttgaactggggaagcaaccaagggggaccaagaaaatgaaaaaggcactcctaagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgacgctgctcagggatctggacataccaagtccattctcaaccttcggacaagcacagagaccaacaatccatgcgccaagacaattgtcaaattatttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 2946 - RNA, 1449 nt, synthetic construct
  misc_feature 1..1449: note = derived and/or modified CDS sequence (wt) from CCHFV(36-ST-2014)__KR814838.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggacaagtttgtgttccagatggccagcgccactgatgatgcacaaaaggactccatctatgcatcggctctggtggaagcaaccaagttctgtgcacccatatatgaatgtgcttgggtcagctctaccggcattgtgaagaaagggcttgagtggttcgagaagaatacaggaaccattaaatcctgggatgataactatgctgagctgaaggttgatgttccaaaaatagaacaacttgccaattaccaacaggctgctctcaagtggaggaaggatataggttttcgtgtcaatgcaaacacggcagccttaagcaacaaggtccttgcagaatataaggtccctggcgaaattgtgatgtctgttaaagaaatgctgtcggacatgattagaaggaggaatctaatcctcaataggggcggtgatggaaatccacgcggcccagtgagccatgaacatgtggagtggtgcagagaatttgtcaaaggcaagtatatcatggccttcaatccaccttggggggacatcaacaaatcaggccgctcaggaatagcactcgttgcaacaggccttgccaagcttgcagagaccgaggggaaaggagtttttgacgaagctaagaggaccgtggaggctctcaatgggtacttggacaagcacagggacgaagttgacaaagcaagtgctgacagcatgataacaaacctcctgaagcacattgccaaagcacaagagctctataagaattcatctgctcttcgtgcacaaggtgcacagattgacacccctttcagctcattttactggctctacaaggccggcgtgactccagagaccttcccaactatctcacagttccttttcgaactgggaaagcaaccaagggggaccaaaaaaatgaaaaaggcactcctgagcactccaatgaaatgggggaagaaactttatgagctctttgctgatgactctttccagcagaacaggatctacatgcaccctgctgtgttgacagctggtagaatcagtgaaatgggtgtctgctttggaacaatccctgttgccaatcctgatgacgctgctcaagggtctggacataccaagtccattctcaaccttcggacaagcacagagaccaacaatccatgtgccaagacaattgtcaaattgtttgaaatccaaaaaacaggatttaacatacaagacatggacattgtagcctctgagcacctgctgcaccaatcccttgttggcaagcagtctccattccaaaatgcctacaacgtcaagggcaatgccaccagtgccaacatcatctaa

SEQ ID NO: 2947 - RNA, 1449 nt, synthetic construct
  misc_feature 1..1449: note = derived and/or modified CDS sequence (wt) from CCHFV(37-ST-2009)__KR814835.1__N
  source 1..1449: mol_type = other RNA
atggagaacaagattgtggtgaacagtaaggatgaaatgaacaagtggtttgaagaatttaagaaggtgaacgggcttgtggacaccttcacaaactcttactccttctgcgagaatgtgccaaatctagacaaatttgtcttccaaatggcaagtgcaactgatgatgcacagaaggattccatctatgcatcggcactagttgaagccaccaagttctgtgcgcccatatatgagtgtgcctgggtcagttccaccggcattgtgaaaaagggacttgagtggtttgagaagaatgcagggaccattaaatcttgggacgaaagctacaccgagcttaaagtggatgtccccaagatagaacagcttgccagctaccaacaggctgccctcaagtggagaaaggacataggcttccgtgtcaatgcaaacacagcagccctgagtagcaaagtgctttcggagtacaaagtcccgggggaggtcgtgatgcctgtgaaagaaatgctgtcagatatgataagaaggagaaatctaattctcaaccggggaagtgatgagaacccacggggaccggtcagccgtgaacacgtagagtggtgcagggaattcgttaaaggcaagtacatcatggccttcaaccctccctggggtgacatcaacaaatcaggccgctcggggattgcacttgtcgccacaggccttgccaaacttgcagagaccgagggaaaaggcatcttcgaagaggccaggaaaaccgtcgatgccctcaaggattaccttgacagacataaggaagaggttgacaagacaaatgctgacaatatggtcacaaacctctttaaacacattgccaaggctcaggaactctacaagaactcatctgcactacgtgcacagggtgcacagatcgacactcctttcagttcattttactggctctacaaggctggcgttacccccgaaacatttcccactgtctcacagttcctctttgagctgggcaagcagcctaggggcaccaggaagatgaagaaggcactcttgagcaccccaatgaaatggggaaagaagctttatgagctctttgctgacgactccttccagcagaacagaatctacatgcatcctgctgtgctgacagccggcagggtcagtgaaatgggtgtctgctttggaacaatcccagtggacaaccctgacgatgcagcacaagggtctgggcataccaagtccattctcaaccttcgtacaagcgctgagaccaacaacccatgtgccaggacaattgtcaagctgtttgaaatccagaaagcaggattcaacatacaggaaatggacattgtggcttcagaacatctgctgcatcagtcacttgtgggaaagcagtccccgttccagaatgcctacaatgtcaaggggaatgccaccagcgccaacatcatctaa

SEQ ID NO: 2948 - RNA, 1449 nt, synthetic construct
  misc_feature 1..1449: note = derived and/or modified CDS sequence (wt) from CCHFV(59-TK-2012)__KR814833.1__N
  source 1..1449: mol_type = other RNA
atggaaaacaagattgtggtgaacagtaaggatgaaatgaacaagtggtttgaagaatttaagaaggtaaacgggcttgtggacaccttcacaaactcttactccttctgcgagaatgtgccaaatctagacaagtttgtcttccaaatggcaagtgcaactgatgatgcacagaaagattccatctatgcatcggcactagttgaagccaccaagttctgtgcgcccatatatgagtgtgcctgggtcagttccaccggcattgtgaaaaagggacttgagtggtttgagaagaatacagggaccattaaatcttgggacgaaagctacaccgagcttaaagtggatgtccccaagatagaacagcttgccagctaccaacaggctgcccttaagtggagaaaggacataggtttccgtgtcaatgcaaacacagcagccctgagtagcaaagtgctttcggagtacaaagtcccaggggagatcgtgatgcctgtgaaagaaatgctgtcagatatgataagaaggaggaatctgattctcaaccggggaagtgatgagaacccacgaggtccggtcagccgtgaacacgtggagtggtgtagggaattcgttaaaggcaagtacatcatggccttcaaccctccctggggtgacatcaacaaatcaggccgctcggggattgcacttgtcgccacaggccttgccaaacttgcagagaccgagggaaaaggcatcttcgaagaggccagaaaaaccgtcgatgccctcaaggattaccttgacagacataaggaagaggttgacaagacaaatgctgacaatatggtcacaaacctctttaagcacattgccaaggctcaggaactctacaagaactcatctgcactacgtgcacagggtgcacagatcgacactcctttcagttcattttactggctctacaaggctggagtcacccccgaaacatttcccactgtctcacagttcctctttgagctgggcaagcagcctaggggcaccaggaagatgaagaaggcactcttgagcaccccaatgaaatgggggaagaagctttatgagctctttgctgacgactccttccagcagaacagaatctacatgcatcctgccgtgctgacagccggcaggatcagtgaaatgggtgtctgctttggaacaatcccggtagacaaccctgacgatgcagcacaagggtctgggcataccaagtccatactcaaccttcgtacaagcgctgagaccaacaacccgtgtgccaagacaattgtcaagctgtttgaaatccagaaagcaggattcaacatacaggaaatggacattgtggcttcagaacatctgctgcaccagtcacttgtgggaaagcaatccccgttccagaatgcctacaatgtcaaggggaatgccaccagcgccaacatcatctaa

SEQ ID NO: 2949 - RNA, 1449 nt, synthetic construct
  misc_feature 1..1449: note = derived and/or modified CDS sequence (wt) from CCHFV(73-ST-2013)__KR814836.1__N
  source 1..1449: mol_type = other RNA
atggaaaacaaaatcgaggtgaataacaaagatgagatgaacaagtggtttgaagagttcaaaaaaggaaatggacttgtggacaccttcacaaactcctattctttttgtgagagtgttccaaatttggataagtttgtgttccaaatggccagtgctaccgatgatgcacaaaaggattccatctacgcgtctgctctggtggaggcaacaaaattttgtgcacctatatatgagtgtgcatgggttagctccactggcattgtgaagaagggacttgaatggttcgaaaaaaatgcgggcaccattaagtcttgggatgaaagttatactgagctaaaagttgacgtcccgaaaatagaacaacttgccaattaccaacaggctgccttgaaatggaggaaagacataggtttccgtgtcaatgcgaacacagcagctctgagcaacaaagtcctcgcagagtacaaagttcctggcgagattgtaatgtctgtcaaagagatgctgtcagacatgattaggagaaggaaccagattctaaacaggggtggtgatgagaatccacgtggccctgtgagccgtgagcatgtggactggtgcagggagtttgtcaaaggtaaatacatcatggccttcaacccaccatggggggacatcaacaagtcaggccgttcaggaatagcacttgtcgcaacaggccttgccaagcttgcagagactgaaggaaagggagtttttgacgaagccaaaaagactgtggaggccctcaatgggtatctggacaagcacaaggacgaagttgacagagcgagtgctgacagcatgataacaaaccttctcaagcacattgccaaggcacaggagctttataagaattcgtctgcactccgtgcacaaggtgcacagatcgacactgctttcagctcatactattggctttacaaggctggcgtgaccccagagaccttcccgacagtgtcgcagttcctctttgagctaggaaaacagcctagaggtaccaagaaaatgaagaaggctctgctgagcaccccaatgaagtgggggaagaaactttatgaactctttgctgacgattctttccagcagaacaggatctacatgcaccctgccgtgcttacagctggcagaatcagtgaaatgggagtctgctttgggacaatccccgtggccaatcctgatgatgctgcccaaggatctggacataccaagtctattctcaacctccggactaacaccgagaccaacaatccgtgtgccagaaccattgtcaagctgtttgaaatccagaaaacagggttcaacattcaggacatggacatagtggcctctgaacacttgctacaccaatctcttgttggcaagcaatctccattccagaacgcctacaacgtcaagggcaatgccaccagtgctaacatcatctaa

SEQ ID NO: 2950 - RNA, 1449 nt, synthetic construct
  misc_feature 1..1449: note = derived and/or modified CDS sequence (wt) from CCHFV(75-ST-2010)__KR814845.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagcgccactgatgatgcacagaaggactccatctatgcatcggctctggtggaagcaaccaagttctgtgcacccatatatgaatgtgcctgggtcagctctaccggcattgtgaagaaggggcttgagtggttcgagaagaattcaggaaccatcaaatcctgggatgagaactatgctgagctgaaggttgatgttcccaaaatagaacaacttgccaattaccaacaggctgctctcaagtggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatctaattctcaacaggggcagtgatgaaaatccgcgcggcccagtgagccgtgaacatgtggaatggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagccaagaagaccgtggaggctctcaatgggtatttggacaagcacagggacgaagttgacaaagcaagtgccgacagcatgataacaaacctcctgaagcacattgccaaagcacaagagctttataaaaattcatctgctcttcgtgcacaaggtgcacagattgacacccctttcagctcgttttactggctttacaaggccggtgtgactccagagaccttcccaactatctcacagttccttttcgaactgggaaagcaaccaagggggaccaagaaaatgaaaaaggcactcctgagcactccaatgaagtgggggaagaaactttatgagctctttgctgatgactctttccagcagaacagaatctatatgcaccctgctgtgttgacagccggtagaatcagtgaaatgggtgtctgctttggaacaatccctgttgccaatcctgatgacgctgctcagggatctggacataccaagtccattctcaaccttcggacaagcacagagaccaacaatccatgcgccaagacaattgtcaaattgtttgaaatccagaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 2951 - RNA, 1449 nt, synthetic construct
  misc_feature 1..1449: note = derived and/or modified CDS sequence (wt) from CCHFV(CHH)__KU707898.1__N
  source 1..1449: mol_type = other RNA
atggaaaacaaaatcgaggtgaacagcaaagatgagatgaacaagtggtttgaggagtttaagaaaggaaatggacttgtggacaccttcacaaactcctattccttttgtgaaagcgttccaaatctggacagatttgtattccagatggctagtgccactgatgatgcacaaaaggattccatctacgcatcagctctggtggaggcaaccaaattttgcgcacctatatacgaatgtgcctgggctagctccactggcattgttaagaagggactggagtggttcgaaaaaaatgcagggaccattaaatcttgggatgaaagttatactgagctgaaagttgaggttcccaaaatagaacagctttccaactaccagcaggctgctctcaagtggaggaaagacataggcttccgtgtcaatgcaaacacagcagctttgagcaacaaggtccttgcagaatacaaagttcctggcgaaattgtaatgtctgtcaaagagatgttgtcagatatgattaggagaaggaacctgattctcaacagaggtggtgatgaaaacccacgcggcccagtcagccgtgaacatgtggaatggtgtagggaatttgtcaaaggcaagtacataatggctttcaacccaccttggggggatatcaacaagtcaggccgttcaggaatagcacttgttgcaacaggccttgccaagcttgcagaaactgaagggaagggagtttttgatgaagccaagaaaactgtagaggctctcaacgggtacctggacaagcataaggacgaggttgacaaagcaagtgctgacagcatgataacaaaccttctcaagcatattgctaaagcacaggagctttacaaaaactcgtctgctctccgtgcacagggtgcacagattgataccgtcttcagctcgtactactggctctacaaggccggcgtgactccagatactttcccgactgtctcacagttcctttttgagttagggaagcagccaaggggtaccaaaaaaatgaagaaggcactcttgagcaccccaatgaagtgggggaagaagctttatgagcttttcgccgatgattccttccagcagaacaggatctacatgcaccctgctgtgctgacagctggcagaatcagtgaaatgggtgtctgctttggaacaatccctgtggccaatcctgatgatgccgccttaggatctgggcacaccaagtccattctcaaccttcggacaaacactgagaccaacaatccatgtgccaagacaattgttaagttgtttgaaattcaaaaaacagggttcaacatacaggacatggacattgtggcctctgagcacctgctgcaccaatcccttgttggcaagcagtctccatttcaaaatgcctacaacgtcaaggggaacgccaccagtgccaacatcatctaa

SEQ ID NO: 2952 - RNA, 1449 nt, synthetic construct
  misc_feature 1..1449: note = derived and/or modified CDS sequence (wt) from CCHFV(CJH)__KU707899.1__N
  source 1..1449: mol_type = other RNA
atggaaaacaaaatcgaggtgaaaaacaaacatgagaagaacaagtggtttgaggagttcaagaaaggaaatggacttgtggacactttcacaaactcctattccttttgtgaaaacgttccaaatctggacagatttgtgttccagatggctggtgccactgatgatgcacaaaaggactccatctacgcatcagctctggtggaagcaaccaaattttgcgcacctatatacgagtgtgcctgggctagctccactggcattgttaagaagggactggagtggtttgaaaaaaatgcagggactattaaatcttgggatgaaagttatactgagctgaaagttgaagttcccaaaatagaacaactttccaactaccaacaggctgctctcaagtggaggaaagacataggcttccgtggcaatgcaaacacagcagctttgagtaacaaagtcctagcagaatacaaagttcctggcgaaattgtaatgtctgtcaaagagatgttgtcagatatgattagaagaaggaacctgattctcaacagaggtggtgatgaaaacccacgcggcccagtcagccgtgaacatgtggagtggtgtagggaatttgttaaaggcaaatacataatggctttcaacccaccttggggggatatcaacaagtcaggccgttcaggaatagcacttgttgcaacaggccttgccaagcttgcagaaactgaggggaagggagtttttgatgaagccaagaagactgtagaggctctcaacgggtacttggacaagcataaggacgaagttgacaaagcaagtgctgacagcatgataacaaacctccttaagcatattgctaaggcacaagagctttacaaaaactcgtctgctcttcgtgctcagggtgcacagattgacaccgtcttcagctcttactactggctctacaaggccggtgtgactccagagaccttcccgactgtctcacagttcctttttgagttagggaagcaaccaaggggtaccaagaaaatgaagaaggcactcttgagcaccccaatgaagtggggaaagaagctttatgagctttttgccgatgattctttccagcagaacagaatctacatgcaccctgctgtgctgacagctggcagaatcagtgaaatgggtgtctgttttggaacaatccctgtggccaatcctgacgatgccgccttaggatctgggcacaccaagtctattctcaaccttcggacaaacactgagaccaacaatccatgtgccaagacaattgttaagttgtttgaaattcaaaaaacagggtttaacatacaggacatggacattgtggcctccgagcacctgctgcaccaatcccttgttggcaagcagtctccatttcaaaatgcctacaacgtcaaggggaatgccaccagtgccaatatcatctaa

SEQ ID NO: 2953 - RNA, 1449 nt, synthetic construct
  misc_feature 1..1449: note = derived and/or modified CDS sequence (wt) from CCHFV(CLT/TI05146)__DQ227496.1__N
  source 1..1449: mol_type = other RNA
atggagaacaagatcgaggtgaataacaaagatgagatgaataagtggtttgaagagttcaagaaaggaaatggacttgtggacactttcacaaactcctactccttttgtgagagtgttccaaatctggatagatttgtatttcagatggccagtgccactgatgatgcacaaaaggattccatctacgcatcagctctggtggaagcaactaagttctgcgcacccatatacgagtgtgcctgggttagctccactggtattgtgaagaagggattggagtggttcgaaaaaaatgcaggaaccattaaatcttgggatgaaagctacactgagctgaaggtcgaggttcccaaaatagaacagcttgccgattaccaacaggctgctctcaagtggaggaaggacataggtttccgtgtcaatgcaaatacgacagccttaagccacaaagtcctcgcagagtacaaagtccctggtgaaattgttatgtctgtcaaagaaatgctgtcagatatgattagaagaaggaacttgattctcaacagaggtggcgatgaaaatccacgaggcccagtgagccgtgaacatgtggagtggtgcagggagtttgtcaaaggcaagtacatcatggctttcaacccaccttggggggacatcaacaagtcaggccggtcaggaatagcacttgttgcaacaggccttgccaagcttgcagagactgaagggaagggagtgtttgatgaagcaaaaaagactgtggaggctctcaacgggtacttgaacaaacataaggatgaggttgataaagcaagtgccgacagcatgataacaaaccttcttaaacacattgccaaggcacaggagctttacaaaaactcgtctgcacttcgtgcacagggtgcacagattgacactgctttcagctcatactactggctctataaggccggcgtgactccagaaaccttcccgactgtctcacagttcctttttgaactagggaagcaaccaaggggcaccaagaaaatgaagaaggcactcttgagcaccccactgaaatgggggaagaagctttatgagctctttgctgatgattccttccagcagaacaggatctacatgcaccctgctgtgctgacagccggcagaattagtgagatgggtgtctgctttgggacaatccctgtggccaaccctgatgatgctgcccagggatctggacacaccaagtccattctcaaccttcggacaaacaccgagaccaacaatccgtgtgccaagacaattgtcaagctgtttgaaattcaaaaaacagggttcaacatacaagacatggacattgtggcctctgagcacctgctgcaccaatcccttgtcggcaaacagtctccattccaaaatgcctacaatgtcaagggcaacgccaccagtgccaacatcatctga

SEQ ID NO: 2954 - RNA, 1449 nt, synthetic construct
  misc_feature 1..1449: note = derived and/or modified CDS sequence (wt) from CCHFV(CYT/TI05099)__DQ227495.1__N
  source 1..1449: mol_type = other RNA
atggagaacaaaatcgaggtgaataacaaagatgagatgaataagtggtttgaagagttcaagaaaggaaatggacttgtggacactttcacaaactcctactccttttgtgagagtgttccaaatctggatagatttgtatttcagatggccagtgccactgatgatgcacaaaaggattccatctacgcatcagctctggtggaagcaactaagttctgcgcacccatatacgagtgtgcctgggttagctccactggtattgtgaagaagggattggagtggttcgaaaaaaatgcaggaaccattaaatcttgggatgaaagctacactgagctgaaggtcgaggttcccaaaatagaacagcttgccgattaccaacaggctgctctcaagtggaggaaggacataggtttccgtgtcaatgcaaatacgacagccttaagccacaaggtcctcgcagagtacaaagtccctggtgaaattgttatgtctgtcaaagaaatgctgtcagatatgattagaagaaggaacttgattctcaacagaggtggcgatgaaaatccacgaggcccagtgagccgtgaacatgtggagtggtgcagggagtttgtcaaaggcaagtacatcatggctttcaacccaccttggggggacatcaacaagtcaggccggtcaggaatagcacttgttgcaacaggccttgccaagcttgcagagactgaagggaagggagtgtttgatgaagcaaaaaagactgtggaggctctcaacgggtacttgaacaaacataaggatgaggttgataaagcaagtgccgacagcatgataacaaaccttcttaaacacattgccaaggcacaggagctttacaaaaactcgtctgcacttcgtgcacagggtgcacagattgacactgctttcagctcatactactggctctataaggccggcgtgactccagaaaccttcccgactgtctcacagttcctttttgaactagggaagcaaccaaggggcaccaagaaaatgaagaaggcactcttgagcaccccactgaaatgggggaagaagctttatgagctctttgctgatgattccttccagcagaacaggatctacatgcaccctgctgtgctgacagccggcagaattagtgagatgggtgtctgctttgggacaatccctgtggccaaccctgatgatgctgcccagggatctggacacaccaagtccattcccaaccttcggacaaacaccgagaccaacaatccgtgtgccaagacaattgtcaagctgtttgaaattcaaaaaacagggttcaacatacaagacatggacattgtggcctctgagcacctgctgcaccaatcccttgtcggcaaacagtctccattccaaaatgcctacaatgtcaagggcaacgccaccagtgccaacatcatctga

SEQ ID NO: 2955 - RNA, 1449 nt, synthetic construct
  misc_feature 1..1449: note = derived and/or modified CDS sequence (wt) from CCHFV(Dubai 616)__JN108025.1__N
  source 1..1449: mol_type = other RNA
atggagaataaaatcgaggttaataacaaagatgagatgaacaagtggtttgaagagttcaagaaaggaaatggacttgtggacactttcacaaactcctactccttttgtgagagtgttccaaatctggacagatttgtattccagatggccggtgccactgatgatgcacaaaaggattccatctacgcatcagctctagtagaagcaaccaaattctgcgcacctatatatgagtgtgcctgggttagctccactggcattgtgaagaagggactggagtggttcgaaaaaaatgcaggaaccattaaatcttgggatgaaagctacactgagctgaaagttgaggtccctaagatagagcagcttgccaattaccaacaggctgctctcaagtggagaaaggacatagggttccgtgtcaatgcaaatacggcagccttaagccacaaagttctcgcagagtacaaagtccctggtgaaattgtaatgtctgtcaaagaaatgttgtcagatatgatcagaaggaggaacttaattctcaacagaggaggcgatgaaaacccacgaggcccggtgagccgtgaacatgtggaatggtgcagggaatttgtcaaaggcaagtacatcatggctttcaacccgccttggggcgacatcaacaagtcaggccgttcaggaatagcactcgttgcaacaggccttgccaagcttgcagagactgaagggaagggagtgtttgatgaagcaaaaaagactgtggaggcactcaacgggtacctggacaagcataaggatgaggttgacaaagcaagtgccgacaacatgataacaaaccttcttaaacacattgccaaggcacaggagctttataaaaactcgtctgcgcttcgtgcacagggtgcacaaattgacactgctttcagctcatactactggctctacaaggccggtgtgactccagaaaccttccctactgtctcacagttcctcttcgaactagggaagcaaccaaggggtacaaagaaaatgaagaaggcactcttgagcaccccaatgaagtgggggaaaaagctttatgagctctttgccgatgattcttttcagcagaataggatctacatgcaccctgctgtgctgacagccggcagaatcagtgagatgggtgtctgctttggaacaatccctgtggccaatcctgatgacgccgcccagggatccggacacaccaagtccattcttaatcttcgaacaaacaccgagaccaacaatccgtgtgccaagacaattgttaagctgtttgaaattcaaaagacagggtttaacatacaggacatggacatcgtggcctctgagcacctgctgcaccagtctcttgtcggtaagcagtctccattccaaaatgcctacaatgtcaaaggcaacgctaccagtgccaacatcatctaa

SEQ ID NO: 2956 - RNA, 1449 nt, synthetic construct
  misc_feature 1..1449: note = derived and/or modified CDS sequence (wt) from CCHFV(GRH)__KU707900.1__N
  source 1..1449: mol_type = other RNA
atggaaaacaaaatcgaggtgaacagcaaagatgagatgaacaagtggtttgaggagttcaagaaaggaaatggacttgtggacaccttcacaaactcctattccttttgtgaaagcgttccaaatctggacagatttgtattccagatggctagtgccactgatgatgcacaaaaggattccatctacgcatcagctctagtggaggcaaccaaattttgcgcacctatatacgagtgtgcctgggctagctccactggcattgttaaaaagggactggagtggttcgaaaaaaatgcaggaaccattaaatcttgggatgaaagttatactgagctgaaagttgaggttcccaaaatagaacagctttccaactaccaacaggctgctctcaagtggaggaaagacataggcttccgtgtcaatgcaaacacagcagctttgagcaacaaggtccttgcagaatacaaagttcctggcgaaattgtaatgtctgtcaaagagatgttgtcagatatgattaggagaaggaacctgattctcaacagaggtggtgatgaaaacccacgcggcccagtcagccgtgaacatgtggagtggtgtagggaatttgtcaaaggcatgtacataatggctttcaacccaccttggggggatatcaacaagtcaggccgttcaggaatagcacttgttgcaacaggccttgccaagcttgcagaaactgaagggaagggagtttttgatgaagccaagaaaactgtagaggctctcaacgggtacctggacaagcataaggacgaggttgacaaagcaagtgctgacagcatgataacaaaccttctcaagcatattgctaaagcacaggagctttacaaaaactcgtctgctctccgtgcacagggtgcacagattgataccgtcttcagctcgtactactggctctacaaggccggtgtgactccagatactttcccaactgtctcacagttcctttttgagttagggaagcagccaaggggtaccaaaaaaatgaagaaggcactcttgagcaccccaatgaagtgggggaagaagctttatgagcttttcgccgatgattccttccagcagaacaggatctacatgcaccctgctgtgctgacagctggcagaatcagtgaaatgggtgtctgctttggaacaatccctgtggccaatcctgatgatgccgccttaggatctgggcacaccaagtccattctcaaccttcggacaaacactgagaccaacaatccatgtgccaagacaattgttaagttgtttgaaattcaaaaaacagggttcaacatacaggacatggacattgtggcctctgagcacctgctgcaccaatcccttgttggcaagcagtctccatttcaaaatgcctacaacgtcaaggggaacgccaccagtgccaacatcatctaa

SEQ ID NO: 2957 - RNA, 1449 nt, synthetic construct
  misc_feature 1..1449: note = derived and/or modified CDS sequence (wt) from CCHFV(Iran-Gilan69)__KJ027521.1__N
  source 1..1449: mol_type = other RNA
atggaaaacaagatcgaggtgaacagcaaagatgaaatgaacaaatggtttgaagagtttaaaaagggaaatggacttatggatactttcacaaactcctactccttttgtgagaatgtaccaaatctggataagtttgtgttccagatggccagcgccactgatgatgcacagaaggattccatctatgcatcggctctggtggaagcaaccaagttctgtgcacccatatatgaatgtgcctgggtcagctctaccggcattgtgaagaaggggcttgagtggttcgagaagaattcaggaaccatcaaatcctgggatgagaactatgctgagctgaaggttgatgttcccaaaatagaacaacttgccagttaccaacaggctgctctcaagtggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatttaattctcaacaggggtggtgatgaaaatccgcgcggcccagtgagccgtgaacatgtggagtggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagccaagaagaccgtggaggctctcaatgggtatttggacaagcacagagacgaagttgacaaagcaagtgctgacagcatgataacaaacctcctgaagcacattgccaaagcacaagagctttataaaaattcatctgctcttcgtgcacaaggtgcacagattgacactcctttcagctcgttttactggctttacaaggccggtgtgactccagagaccttcccaactatctcacagttccttttcgaactggggaagcaaccaagggggaccaagaaaatgaaaaaggcactcctgagcactccaatgaagtgggggaagaaactttatgagctctttgctgatgactctttccagcagaacagaatctacatgcaccctgctgtgttgacagccggcagaatcagtgaaatgggtgtctgctttggaacaatccctgttgccaatcctgatgacgctgctcagggatctggacacaccaagtccattctcaaccttcggacaagcacagagaccaacaatccatgcgccaagacaattgtcaaattgtttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctga

SEQ ID NO: 2958 - RNA, 1449 nt, synthetic construct
  misc_feature 1..1449: note = derived and/or modified CDS sequence (wt) from CCHFV(Iran-Isfahan78)__KJ027522.1__N
  source 1..1449: mol_type = other RNA
atggaaaacaagatcgaggtgaacagcaaagatgagatgaacaagtggtttgaggagtttaaaaagggaaatggacttatggacactttcacaaactcctactccttttgtgagaatgtaccaaatctggataagtttgtgttccagatggccagcgccactgatgatgcacagaaggactccatctatgcatcggctctggtggaagcaaccaagttctgtgcacccatatatgaatgtgcttgggtcagctctaccggcattgtgaagaaggggcttgagtggttcgagaagaattcaggaaccatcaaatcttgggatgagaactatgctgagctgaaggttgatgttcccaaaatagaacaacttgccaattaccaacaggctgctctcaagtggaggaaggacataggtttccgtgtcaatgcaaacacggcagccttaagcaacaaagtccttgcagaatataaagtccctggcgaaattgtgatgtctgttaaagaaatgctgtcagacatgattagaaggaggaatctaattctcaacaggggcggtgatgaaaatccacgcggcccagtgagccgtgaacatgtagagtggtgcagggaatttgtcaaaggcaagtacatcatggccttcaatccaccttggggggacatcaacaaatcaggccgttcgggaatagcacttgttgcaacaggccttgccaagcttgcagaaaccgaggggaaaggagtttttgacgaagctaagaagaccgtggaggctctcaatgggtatttggacaagcacagggacgaagttgacaaagcaagtgctgacagcatgataacaaacctcctgaagcacattgccaaagcacaagagctttataaaaattcatctgctcttcgtgcacaaggtgcacagattgacacccccttcagctcgttttactggctctacaaggccggtgtgactccagagaccttcccaactgtctcacagttcctttttgaactggggaagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggcagaatcagtgaaatgggtgtctgctttggaacgatccccgttgccaatcctgatgacgctgctcagggatctggacataccaagtccattctcaaccttcggacaagcacagagaccaacaatccatgcgccaagacaattgtaaaattatttgaaatccaaaaaacaggatttaacatacaggacatggacattgtagcctctgagcacctgctgcaccagtcccttgttggcaagcagtctccattccagaatgcctacaacgtcaagggcaatgccaccagtgccaacatcatctaa

SEQ ID NO: 2959 - RNA, 1449 nt, synthetic construct
  misc_feature 1..1449: note = derived and/or modified CDS sequence (wt) from CCHFV(Iran-KhRazavi72)__KJ485700.1__N
  source 1..1449: mol_type = other RNA
atggaaaacaaaatcgaggtgaaaaataaacatgagaagaacaaatggtttgaggagttcaagaaaggaaatggacttgtggacactttcccaaactcatattccttttgtgaaaacgttccaaatctggacagatttgtgttccagatggctggtgccactgatgatgcacaaaaggactccatctacgcatctgctctggtggaagcaaccaaattttgtgcacctatatacgagtgtgcctgggctagctccactggcattgttaagaagggactggagtggtttgaaaaaaatgcagggactattaaatcttgggatgagagttatactgagctgaaagttgaagttcccaaaatagaacaactttccaactaccaacaggctgctctcaagtggaggaaagacataggcttccgtggcaatgcaaacacagcagctttgagtaataaagtcctagcagaatacaaagttcctggcgaaattgtaatgtccgtcaaagagatgttgtcagatatgattagaagaaggaacctgattctcaacagaggtggtgatgaaaacccacgcggcccagtcagccgtgaacatgtggagtggtgtagggaattcattaaaggcaaatacataatggccttcaacccaccttggggggacatcaacaagtcaggccgttcaggaatagcacttgttgcaacaggccttgccaagcttgcagaaactgaggggaagggggtttttgatgaagccaagaagactgtagaggctctcaacgggtacttagacaagcataaggacgaagttgacaaagcaagtgctgacagcatgataacaaacctccttaagcatattgctaaggcacaagagctttacaaaaactcgtctgctcttcgtgctcagggtgcacagattgacaccgtcttcagctcttactactggctctacaaggccggtgtgactccagagaccttcccgactgtctcacagttcctttttgagttagggaaacaaccaaggggtaccaagaaaatgaagaaggcactcttgagcaccccaatgaagtggggaaagaagctttatgagctttttgccgatgattctttccagcagaacagaatctacatgcaccccgctgtgctaacagccggcagaatcagtgaaatgggtgtctgttttggaacaatccctgtggccaatcctgacgatgccgccttaggatctgggcacaccaagtctattctcaaccttcggacaaacactgagaccaacaatccatgtgccaagacaattgttaagttgtttgaaattcagaaaacagggtttaacatacaggacatggatattgtggcctccgagcacctgctgcaccaatcccttgttggcaagcagtctccatttcaaaatgcctacaacgtcaagggaaatgccaccagtgccaacatcatctaa

SEQ ID NO: 2960 - RNA, 1449 nt, synthetic construct
  misc_feature 1..1449: note = derived and/or modified CDS sequence (wt) from CCHFV(Iran-Zahedan19)__KJ676542.1__N
  source 1..1449: mol_type = other RNA
atggagaataaaatcgaggttaataacaaagatgagatgaacaagtggtttgaagagttcaagaaaggaaatggacttgtggacactttcacaaactcctactccttttgtgagagtgttccaaatctggatagatttgtatttcagatggccggtgctactgatgatgcacaaaaggattccatctacgcatcagctctagtggaggcaactaaattttgcgcacccatatatgagtgtgcctgggttagctccactggtattgtgaaaaagggactagagtggttcgaaaaaaatgcaggaaccattaaatcttgggatgaaagctacactgagctgaaagttgaagtccccaaaatagagcagcttgccaattaccaacaggctgctctcaagtggagaaaggacataggtttccgtgtcaatgcaaatacggcagccttaagccacaaagtcctcgcagaatataaagtccctggtgaaattgtaatgtctgtcaaagaaatgttgtcagatatgattagaaggaggaacttgattctcaacagaggtggcgatgaaaatccacgaggcccagtgagccgtgaacatgtggaatggtgcagggagtttgtcaaaggtaagtacatcatggctttcaacccaccttggggtgatatcaacaagtcaggtcggtcaggaatagcacttattgcaacaggccttgccaagcttgcagagactgaagggaaaggagtgtttgatgaagcaaaaaagactgtggaggctctcaacgggtacctagacaagcataaggacgaggttgacaaagcaagtgccgacaacatgataacaaaccttcttaaacacatcgccaaggcacaggagctttacaaaaactcgtctgcacttcgtgcacagggtgcacagattgacactgctttcagctcatactactggctctacaaggccggcgtgactccagaaaccttcccaactgtctcacagttccttttcgaactagggaagcaaccaaggggtaccaagaaaatgaagaaagcactcttgagcactccaatgaggtgggggaagaagctctatgagctctttgctgatgattctttccagcagaacaggatctacatgcatcccgctgtgttgacagccggcagaatcagtgagatgggtgtttgctttggaacaatccctgtggccaatcctgatgatgccgcccagggatccggacacaccaagtccattcttaatcttcgaacaaacaccgagaccaacaatccgtgtgccaagacaattgtcaagttgtttgaaattcaaaaaacagggtttaacatacaggacatggacattgtagcctctgagcacctgctgcaccagtctcttgtcggcaagcagtctccattccaaaatgcctacaatgttaagggcaacgctacaagtgccaacatcatctga

SEQ ID NO: 2961 - RNA, 1449 nt, synthetic construct
  misc_feature 1..1449: note = derived and/or modified CDS sequence (wt) from CCHFV(NIV 112143)__JN572089.1__N
  source 1..1449: mol_type = other RNA
atggagaataaaatcgaggtgaacaacaaagatgagatgaacaagtggtttgaagagttcaagaaaggaaatggacttgtggacactttcacaaactcctactccttttgtgagagtgttccaaatctggacagatttgtatttcagatggccagtgctactgatgatgcacaaaaggattctatctacgcatctgctctagtggaggcaaccaaattttgcgcacccatatacgagtgtgcttgggttagctccactggtattgtgaagaagggactggagtggttcgagaaaaatgcaggaaccattaaatcttgggatgaaagctacactgagctgaaagttgaggtccctaaaatagagcagcttgccaattaccaacaggctgctctaaagtggagaaaggacataggtttccgtgttaatgcaaatacggcagccttgagtcataaggtccttgcagaatataaagtccctggtgaaattgtaatgtctgtcaaagaaatgttgtcagatatgattagaaggaggaacttaattctcaacagaggtggtgatgaaaatccacgaggcccggtgagccgtgaacatgtggaatggtgcagggagtttgtcaaaggtaagtacatcatggctttcaacccaccttggggtgatatcaacaagtcaggtcggtcaggaatagcacttattgcaacaggccttgccaagcttgcagagactgaagggaaaggagtgtttgatgaagcaaaaaagactgtggaggctctcaacgggtacctagacaagcataaggacgaggttgacaaagcaagtgccgacaacatgataacaaaccttcttaaacacatcgccaaggcacaggagctttacaaaaactcgtctgcacttcgtgcacagggtgcacagattgacactgctttcagctcatactactggctctacaaggccggcgtgactccagaaaccttcccaactgtctcacagttccttttcgaactagggaagcaaccaaggggtaccaagaaaatgaagaaagcactcttgagcactccaatgaggtgggggaagaagctctatgagctctttgctgatgattctttccagcagaacaggatctacatgcatcccgctgtgttgacagccggcagaatcagtgagatgggtgtttgctttggaacaatccctgtggccaatcctgatgatgccgcccagggatccggacacaccaagtccattcttaatcttcgaacaaacaccgagaccaacaatccgtgtgccaagacaattgtcaagttgtttgaaattcaaaaaacagggtttaacatacaggacatggacattgtagcctctgagcacctgctgcaccagtctcttgtcggcaagcagtctccattccaaaatgcctacaatgttaagggcaacgctacaagtgccaacatcatctga

SEQ ID NO: 2962 - RNA, 1449 nt, synthetic construct
  misc_feature 1..1449: note = derived and/or modified CDS sequence (wt) from CCHFV(NIVA 118595)__JN572088.1__N
  source 1..1449: mol_type = other RNA
atggagaataaaatcgaggtgaacaacaaagatgagatgaacaagtggtttgaagagttcaagaaaggaaatggacttgtggacactttcacaaactcctactccttttgtgagagtgttccaaatctggacagatttgtatttcagatggccagtgctactgatgatgcacaaaaggattctatctacgcatctgctctagtggaggcaaccaaattttgcgcacccatatacgagtgtgcttgggttagctccactggtattgtgaagaagggactggagtggttcgagaaaaatgcaggaaccattaaatcttgggatgaaagctacactgagctgaaagttgaggtccctaaaatagagcagcttgccaattaccaacaggctgctctaaagtggagaaaggacataggtttccgtgttaatgcaaatacggcagccttgagtcataaggtccttgcagaatataaagtccctggtgaaattgtaatgtctgtcaaagaaatgttgtcagatatgattagaaggaggaacttaattctcaacagaggtggcgatgaaaatccacgaggcccggtgagccgtgaacatgtggaatggtgcagggagtttgtcaaaggtaagtacatcatggctttcaacccaccttggggtgatatcaacaagtcaggtcggtcaggaatagcacttgttgcaacaggccttgccaagcttgcagagactgaagggaaaggagtgtttgatgaagcaaaaaagactgtggaggctctcaacgggtacctagacaagcataaggacgaggttgacaaagcaagtgccgacaacatgataacaaaccttcttaaacacatcgccaaggcacaggagctttacaaaaactcgtctgcacttcgtgcacagggtgcacagattgacactgctttcagctcatactactggctctacaaggccggcgtgactccagaaaccttcccaactgtctcacagttccttttcgaactagggaagcaaccaaggggtaccaagaaaatgaagaaagcactcttgagcactccaatgaggtgggggaagaagctctatgagctctttgctgatgattctttccagcagaacaggatctacatgcatcccgctgtgttgacagccggcagaatcagtgagatgggtgtctgctttggaacaatccctgtggccaatcctgatgatgccgcccagggatccggacacaccaagtccattctcaatcttcgaacaaacaccgagaccaacaatccgtgtgccaagacaattgtcaagttgtttgaaattcaaaaaacagggtttaacatacaggacatggacattgtagcctctgagcacctgctgcaccagtctcttgtcggcaagcagtctccattccaaaatgcctacaatgtcaagggcaacgctacaagtgccaacatcatctga

SEQ ID NO: 2963 - RNA, 1449 nt, synthetic construct
  misc_feature 1..1449: note = derived and/or modified CDS sequence (wt) from CCHFV(SPU 130/89)__KJ682821.1__N
  source 1..1449: mol_type = other RNA
atggaaaacaaaatcgaggtgaataacaaagatgagatgaacaagtggtttgaagagttcaaaaagggaaatggacttgtggacaccttcacaaactcctattccttttgtgagagtgttccaaatttggacaagtttgtgttccaaatggccagtgccactgatgatgcacaaaaggattctatctacgcgtctgctctagtggaggcaacaaaattttgtgcacctatatatgaatgtgcgtgggttagctccactggcattgtgaagaggggacttgaatggttcgaaaaaaatgcgggcaccattaagtcttgggatgaaagttatactgagctaaaagttgacgtcccgaaaatagaacaacttgccaattaccaacaagctgccttgaaatggagaaaggacataggtttccgtgtcaatgcaaacacagcggctttgagcaacaaagtcctcgcagagtacaaagttcctggcgagattgtgatgtctgtcaaagagatgctgtcagacatgattcggagaaggaaccaaattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtttttgacgaagccaaaaagaccgtggaggccctcaatgggtatctggacaagcacaaggacgaagttgacagggcgagtgctgacagcatgataacaaaccttctcaagcacattgccaaggcacaggagctttataagaattcgtctgcactccgtgcacaaggtgcacagattgacactgctttcagctcatactattggctttacaaagctggcgtgaccccagaaaccttcccgacggtgtcgcagttcctctttgagctagggaagcagccaagaggtaccaagaagatgaagaaggctctgctgagcaccccaatgaagtgggggaagaaactttatgagctctttgccgacgattctttccagcagaacaggatctacatgcaccctgccgtgcttacagctggcagaatcagtgaaatgggagtctgctttgggacaatccccgtggccaatcctgatgatgctgcccaaggatctggacacaccaagtccattctcaacctccggactaacaccgagaccaacaatccatgtgccaggaccattgtcaagctgtttgaaattcagaaaacagggttcaacattcaggacatggacatagtggcctctgagcacctgctacaccagtctcttgttggcaagcaatctccattccagaacgcctacaacgtcaagggcaatgccaccagtgccaacattgtctaa

SEQ ID NO: 2964 - RNA, 1449 nt, synthetic construct
  misc_feature 1..1449: note = derived and/or modified CDS sequence (wt) from CCHFV(SPU 18/88)__KJ682818.1__N
  source 1..1449: mol_type = other RNA
atggaaaacaaaatcgaggtgaataacaaagatgagatgaacaagtggtttgaagagttcaaaaagggaaacggacttgtggacaccttcacaaactcctattccttttgtgagagtgttccaaatttggacaagtttgtgttccaaatggccagtgccactgatgatgcacaaaaggattctatctacgcgtctgctctggtggaggcaacaaaattttgtgcacctatatatgagtgtgcgtgggttagctccactggcattgtgaagaggggacttgaatggttcgaaaaaaatgcgggcaccattaagtcttgggatgaaagttatactgagctaaaagttgacgtcccaaaaatagaacaacttgccaattaccaacaagctgccttgaaatggagaaaggacataggtttccgtgtcaatgcaaacacagcggctttgagcaacaaagtcctcgcagagtacaaagtacctggcgagattgtgatgtctgtcaaagagatgctgtcagacatgattcggagaaggaaccaaattctaaacagaggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtttttgacgaagccaaaaagaccgtggaggccctcaatgggtatctggacaagcacaaggacgaagttgacagggcgagtgctgacagcatggtaacaaaccttctcaagcacattgccaaggcacaggagctttataagaattcgtctgcactccgtgcacaaggtgcacagattgacactgctttcagctcatactattggctttacaaagctggcgtgaccccagaaaccttcccgacggtgtcacagttcctctttgagctaggaaagcagccaagaggtactaagaaaatgaagaaggctctgctgagcaccccaatgaagtgggggaagaaactttatgagctctttgccgacgattctttccagcagaacaggatctacatgcaccctgccgtgcttacagctggcagaatcagtgaaatgggagtctgctttgggacaatccccgtggccaatcctgatgatgctgcccaaggatctggacatactaagtccattctcaacctccggactaacaccgagaccaacaatccatgtgccaggaccattgtcaagctgtttgaaattcagaaaacagggttcaacattcaggacatggacatagtggcctctgagcacttgctacaccagtctcttgttggcaagcaatctccattccagaacgcctacaacgtcaagggcaatgccaccagtgccaacattatctaa

SEQ ID NO: 2965 - RNA, 1449 nt, synthetic construct
  misc_feature 1..1449: note = derived and/or modified CDS sequence (wt) from CCHFV(SPU 187/90)__KJ682823.1__N
  source 1..1449: mol_type = other RNA
atggaaaacaaaattgaggtgaataacaaagatgagatgaacaagtggtttgaagagttcaaaaaaggaaatggacttgtggacaccttcacaaactcctattccttttgtgagagtgttccaaatttggacaagtttgtgttccaaatggccagtgccaccgatgatgcacaaaaggattccatctacgcatctgctctggtggaggcaacaaaattttgtgcacctatatatgagtgtgcatgggttagctccactggcattgtgaagaggggacttgaatggttcgaaaaaaatgcgggcaccattaagtcttgggatgaaagttacactgagctaaaagttgacgtcccgaaaatagaacagcttgccaattaccaacaggctgccttgaaatggaggaaagacataggtttccgtgtcaatgcaaacacagcggctctgagcaacaaagtcctcgcagagtacaaagttcctggcgagattgtgatgtctgtcaaagagatgctgtcagacatgattaggagaaggaaccagattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtatttgacgaagccaaaaagactgtggaggccctcaatgggtatctggacaagcacaaggacgaagttgacagagcgagtgctgacagcatgattacaaaccttctcaagcacattgctaaggcacaggagctttataagaattcgtctgcactccgtgcacaaggtgcacagattgacactgccttcagctcatactattggctttacaaggctggcgtgaccccagagacattcccgacggtgtcacagttcctctttgagctaggaaaacagccaagaggtaccaagaaaatgaagaaggctctgctgagcaccccaatgaagtgggggaagaaactttatgaactcttcgccgacgattctttccagcagaacaggatctacatgcaccctgccgtgcttacagctggcagaatcagtgaaatgggagtctgctttgggacaatccccgtggccaatcctgatgatgctgctcaaggatctggacacaccaagtctattctcaacctccagactaacaccgagaccaacaatccgtgtgccaggaccattgtcaagctgtttgaaattcagaaaacagggttcaacattcaggacatggacatagtggcctctgagcacctgctgcaccagtctcttgttggcaagcaatctccattccagaacgcctacaacgtcaaaggcaatgccaccagtgctaacattatctaa

SEQ ID NO: 2966 - RNA, 1449 nt, synthetic construct
  misc_feature 1..1449: note = derived and/or modified CDS sequence (wt) from CCHFV(SPU 383/87)__KJ682816.1__N
  source 1..1449: mol_type = other RNA
atggaaaacaaaatcgaggtgaataacaaagatgagatgaacaagtggtttgaagagttcaaaaagggaaatggacttgtggacaccttcacaaactcctattccttttgtgagagtgttccaaatttggacaagtttgtgttccaaatggccggtgccactgatgatgcacaaaaggattctatctacgcgtctgctctggtggaggcaacaaaattttgtgcacctatatatgagtgtgcgtgggttagctccactggcattgtgaagaggggacttgaatggttcgaaaaaaatgcgggcaccattaagtcttgggatgaaagttatactgagctgaaagttgacgtcccgaaaatagaacaacttgccaattaccaacaagctgccttgaaatggagaaaggacataggtttccgtgtcaatgcaaacacagcggctttgagcaacaaagtcctcgcagagtacaaagttcctggcgagattgtgatgtctgtcaaagagatgctgtcagacatgattcggagaaggaaccaaattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtttttgacgaagcaaaaaagaccgtggaggccctcaatgggtatctggacaagcacaaggacgaagttgacagggcgagtgctgacagcatgataacaaaccttctcaagcacattgccaaggcacaggagctttataagaattcgtctgcactccgtgcacaaggtgcacagattgacactgctttcagctcatactattggctttacaaagctggcgtgaccccagaaaccttcccgacggtgtcgcagttcctctttgagctagggaagcagccaagaggtaccaagaaaatgaagaaggctctgctgagcaccccaatgaagtgggggaagaaactttatgagctctttgccgacgattctttccagcagaacaggatctacatgcaccctgccgtgcttacagctggcagaatcagtgaaatgggagtctgctttgggacaatcccagtggccaatcctgatgatgctgcccaaggatctggacataccaagtccattctcaacctccggactaacaccgagaccagcaatccatgtgccaggaccattgtcaagctgtttgaaattcagaaaacagggttcaacattcaggacatggacatagtggcctctgagcacttgctacaccagtctcttgttggcaagcaatctccattccagaacgcctacaacgtcaagggcaatgccaccagtgccaacattgtctaa

SEQ ID NO: 2967 - RNA, 1449 nt, synthetic construct
  misc_feature 1..1449: note = derived and/or modified CDS sequence (wt) from CCHFV(SPU 383/87)__KJ682816.1__N
  source 1..1449: mol_type = other RNA
atggaaaacaaaatcgaggtgaataacaaagatgagatgaacaagtggtttgaagagttcaaaaagggaaatggacttgtggacaccttcacaaactcctattccttttgtgagagtgttccaaatttggacaagtttgtgttccaaatggccggtgccactgatgatgcacaaaaggattctatctacgcgtctgctctggtggaggcaacaaaattttgtgcacctatatatgagtgtgcgtgggttagctccactggcattgtgaagaggggacttgaatggttcgaaaaaaatgcgggcaccattaagtcttgggatgaaagttatactgagctgaaagttgacgtcccgaaaatagaacaacttgccaattaccaacaagctgccttgaaatggagaaaggacataggtttccgtgtcaatgcaaacacagcggctttgagcaacaaagtcctcgcagagtacaaagttcctggcgagattgtgatgtctgtcaaagagatgctgtcagacatgattcggagaaggaaccaaattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtttttgacgaagcaaaaaagaccgtggaggccctcaatgggtatctggacaagcacaaggacgaagttgacagggcgagtgctgacagcatgataacaaaccttctcaagcacattgccaaggcacaggagctttataagaattcgtctgcactccgtgcacaaggtgcacagattgacactgctttcagctcatactattggctttacaaagctggcgtgaccccagaaaccttcccgacggtgtcgcagttcctctttgagctagggaagcagccaagaggtaccaagaaaatgaagaaggctctgctgagcaccccaatgaagtgggggaagaaactttatgagctctttgccgacgattctttccagcagaacaggatctacatgcaccctgccgtgcttacagctggcagaatcagtgaaatgggagtctgctttgggacaatcccagtggccaatcctgatgatgctgcccaaggatctggacataccaagtccattctcaacctccggactaacaccgagaccagcaatccatgtgccaggaccattgtcaagctgtttgaaattcagaaaacagggttcaacattcaggacatggacatagtggcctctgagcacttgctacaccagtctcttgttggcaagcaatctccattccagaacgcctacaacgtcaagggcaatgccaccagtgccaacatcatctaa

SEQ ID NO: 2968 - RNA, 1449 nt, synthetic construct
  misc_feature 1..1449: note = derived and/or modified CDS sequence (wt) from CCHFV(SPU 431/85)__KJ682815.1__N
  source 1..1449: mol_type = other RNA
atggaaaacaaaattgaggtgaataacaaagatgagatgaacaagtggtttgaagagttcaaaaaaggaaatggacttgtggacaccttcacaaactcctattccttttgtgagagtgttccaaatttggacaagtttgtgttccaaatggccagtgccaccgatgatgcacaaaaggattccatctacgcgtctgctctggtggaggcaacaaaattttgtgcacctgtatatgagtgtgcatgggttagctccactggcattgtgaaaaggggacttgaatggttcgaaaaaaatgcgggcaccattaagtcttgggatgaaagttatactgagctaaaagtcgacgtcccaaaaatagaacagctagccaattaccaacaggctgccttgaaatggaggaaagacataggtttccgtgtcaatgcaaacacagcggctctgagtaacaaagtcctcgcagagtacaaagttcctggagagattgtgatgtctgtcaaagagatgctgtcagacatgattaggagaaggaaccagattctaaacaggggtggtgatgagaatccacgtggccctgtgagccgtgagcatgtagactggtgcagggagtttgtcaaaggcaaatacatcatggccttcaacccaccatggggggacatcaacaagtcaggccgttcaggaatagcacttgtcgcaacaggccttgccaagcttgcagagactgagggaaagggagtatttgacgaagccaaaaagactgtggaagccctcaatgggtatctggacaagcacaaggacgaagttgacagagcgagtgctgacagcatgataacaaaccttctcaagcacattgctaaggcacaggagctttataagaattcgtctgcactccgtgcacaaggtgcacagattgacactgctttcagctcatactattggctttacaaggctggcgtgaccccagagacattcccgacggtgtcacagttcctctttgagctaggaaaacagccaagaggtaccaagaaaatgaagaaggctctgctgagcaccccaatgaagtgggggaagaaactttatgaactctttgccgacgatactttccagcagaacaggatctacatgcaccctgccgtgcttacagctggcagaatcagtgaaatgggagtctgctttgggacaatccccgtggccaaccctgatgatgctgctcaagggtctggacataccaagtctattctcaacctccggactaacaccgagaccaacaatccgtgtgccaggaccattgtcaagctgtttgaaattcagaaaacagggttcaacattcaggacatggacatagtggcctctgagcacttgctgcaccagtctcttgttggcaagcaatctccattccagaacgcctacaacgtcaagggcaatgccaccagtgttaacattatctaa

SEQ ID NO: 2969 - RNA, 1449 nt, synthetic construct
  misc_feature 1..1449: note = derived and/or modified CDS sequence (wt) from CCHFV(SPU 45/88)__KJ682819.1__N
  source 1..1449: mol_type = other RNA
atggaaaacaaaattgaggtgaataacaaagatgaaatgaacaagtggtttgaagagttcaaaaaaggaaatggacttgtggacaccttcacaaactcctattccttttgtgagagtgttccaaatttggacaagtttgtgttccaaatggccagtgccaccgatgatgcacaaaaggattccatctacgcgtctgctctggtggaagcaacaaaattttgtgcacctatatatgagtgtgcatgggttagctccactggcattgtgaagaggggacttgaatggttcgaaaaaaatgcgggcaccattaagtcttgggatgaaagttatactgagctaaaagttgacgtcccgaaaatagaacagcttgctaattaccaacaagctgccttgaaatggaggaaagacataggtttccgtgtcaatgcaaacacagcggctctgagcaacaaagtcctcgcagagtacaaagttcctggcgagattgtgatgtctgtcaaagagatgctgtcagacatgattaggagaaggaaccagattctaaacaggggtggtgatgagaatccacgtggccctgtgagccgtgagcatgtggactggtgcagggagtttgtcaaaggcaaatacatcatggccttcaacccaccatggggagacatcaacaagtcaggccgttcgggaatagcacttgtcgcaacaggccttgccaagcttgcagagactgaaggaaagggagtatttgacgaagccaaaaagactgtggaggccctcaatgggtatctggataagcacaaggacgaagttgacagagcgagtgctgacagcatgataacaaaccttctcaagcacattgctaaggcacaggagctttataagaattcgtctgcactccgtgcacaaggtgcacagattgacactgctttcagctcatactattggctttacaaggctggcgtgaccccagagacattcccgacagtgtcacagttcctctttgagctaggaaaacagccaagaggtaccaaaaaaatgaagaaggctctgctgagcaccccaatgaagtgggggaagaaactttatgaactctttgccgacgattctttccagcagaacaggatctacatgcaccctgctgtgcttacagctggcagaatcagtgaaatgggagtctgctttgggacaatccccgtggccaatcctgatgatgctgctcaaggatctggacataccaagtctattctcaacctccggactaacaccgagaccaacaatccgtgtgccaggaccattgtcaagctgtttgaaattcagaaaacagggttcaacattcaggacatggacatagtggcctctgagcacttgctgcaccagtctcttgttggtaagcaatctccattccagaacgcctacaacgtcaagggcaatgccaccagtgctaacattatctaa

SEQ ID NO: 2970 - RNA, 1449 nt, synthetic construct
  misc_feature 1..1449: note = derived and/or modified CDS sequence (wt) from CCHFV(SPU 48/90)__KJ682822.1__N
  source 1..1449: mol_type = other RNA
atggaaaacaaaatcgaggtgaataacaaggatgagatgaacaagtggtttgaagagttcaaaaagggaaatggacttgtggacaccttcacaaactcctattccttttgtgagagtgttccaaatttggacaagtttgtgttccaaatggccagtgccactgatgatgcacaaaaagattccatctatgcgtctgctctggtggaggcaacaaaattttgtgcacctatatatgagtgtgcatgggttagctccactggcattgtgaagaggggacttgaatggttcgaaaaaaatgcgggcaccatcaagtcttgggatgaaagttatactgagctaaaagttgacgtcccgaaaatagaacaacttgctaattaccaacaggctgccttgaaatggaggaaagacataggtttccgtgtcaatgcaaacacagcggctctgagcaacaaagtcctcgcagagtacaaagttcctggcgagattgtgatgtctgtcaaagagatgctgtcagacatgattaggagaaggaaccagattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtttttgacgaagccaaaaagactgtggaggccctcaatgggtatctggacaagcacaaggacgaagttgacagagcgagtgctgacagcatgataacaaaccttttcaagcacattgccaaggcacaggagctttataagaactcgtctgctctccgtgcacaaggtgcacagattgacactgctttcagctcatactattggctttacaaggctggcgtgaccccagagaccttcccgacggtgtcgcagttcctctttgagctaggaaaacagccaagaggcaccaagaaaatgaagaaggctctgctgagcaccccaatgaagtgggggaagaaactttatgaactctttgccgacgattctttccagcagaacaggatctacatgcaccctgccgtgcttacagctggcagaatcagtgaaatgggagtctgctttgggacaatccccgtggccaatcctgatgatgctgcccaaggatctggacataccaagtccattctcaacctccggactaacaccgagaccaacaacccgtgtgctaggaccattgtcaagttgtttgaaattcagaaaacagggttcagcattcaggacatggacatagtggcctctgagcacttgctgcaccagtctcttgttggcaagcaatctccattccagaacgcctacaatgtcaagggcaatgccaccagtgctaacatcatctaa

SEQ ID NO: 2971 - RNA, 1449 nt, synthetic construct
  misc_feature 1..1449: note = derived and/or modified CDS sequence (wt) from CCHFV(SPU 497/88)__KJ682820.1__N
  source 1..1449: mol_type = other RNA
atggaaaacaaaatcgaggtgaataacaaagatgagatgaacaagtggtttgaagagttcaaaaagggaaatggacttgtggacaccttcacaaactcctattccttttgtgagagtgttccaaatttggacaagtttgtgttccaaatggccagtgccactgatgatgcacaaaaggattctatctacgcgtctgctctggtggaggcaacaaagttttgtgcacctatatatgagtgtgcgtgggttagctccactggcattgtgaagaggggacttgaatggttcgaaaaaaatgcgggcaccattaagtcttgggatgaaagttatactgagctaaaagttgacgtcccgaaaatagaacaacttgccaattaccaacaagctgccttgaaatggagaaaggacataggtttccgtgtcaatgcaaacacagcggctttgagcaacaaagtcctcgcagagtacaaggttcctggcgagattgtgatgtctgtcaaagagatgctgtcagacatgattcggagaaggaaccaaattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtttttgacgaagccaaaaagaccgtggaggccctcaatgggtatctggacaagcacaaggacgaagttgacagggcgagtgctgacagcatgataacaaaccttctcaagcacattgccaaggcacaggagctttataagaattcgtctgcactccgtgcacaaggtgcacagattgacactgctttcagctcatactattggctttacaaagctggcgtgaccccagaaaccttcccgacggtgtcgcagttcctctttgagctagggaagcagccaagaggtaccaagaaaatgaagaaggctctgctgagcaccccaatgaagtgggggaagaaactttatgagctctttgccgacgattctttccagcagaacaggatctacatgcaccctgccgtgcttacagctggaagaatcagtgaaatgggagtctgctttggggcaatccccgtggccaatcctgatgatgctgcccaaggatctggacacaccaagtccattctcaacctccggactaacaccgagaccaacaatccatgtgccaggaccattgtcaagctgtttgaaattcagaaaacagggttcaacattcaggacatggacatagtggcctctgagcacttgctacaccagtctcttgttggcaagcaatctccattccagaatgcctacaacgtcaagggcaatgccaccagtgccaacattatctaa

SEQ ID NO: 2972 - RNA, 1449 nt, synthetic construct
  misc_feature 1..1449: note = derived and/or modified CDS sequence (wt) from CCHFV(SPU 556/87)__KJ682817.1__N
  source 1..1449: mol_type = other RNA
atggaaaacaaaatcgaggtgaataacaaggatgagatgaacaggtggtttgaagagttcaaaaaagggaacggacttgtggacaccttcacaaactcctattccttttgtgagagtgttccaaatttggacagatttgtattccaaatggccggtgccactgatgatgcacaaaaggactccatctatgcatctgctctggtggaggcaacaaaattttgtgcacctatatacgagtgtgcatgggttagctccactggcattgtgaagaagggacttgaatggttcgaaaaaaatgcaggcaccattaagtcctgggatgaaagttacactgaactaaaagtcgacgtcccgaaaatagaacaacttgccaattaccaacaagctgccctgaagtggagaaaagacataggtttccgtgtcaatgcaaacacagcggctttgagcaacaaagtccttgcagagtacaaagttcctggcgagattgtgatgtccgtcaaagagatgctgtctgacatgattaggagaaggaaccaaattctaaacaggggtggtgatgagaatccacgcggcccagtgagccgtgagcatgtagactggtgcagggagtttgtcaagggcaaatacatcatggccttcaacccaccatggggggacataaacaagtcgggccgttcaggaatagcacttgtcgcaacaggccttgccaagcttgcagagactgagggaaagggagtttttgatgaagccaaaaagactgtggaggcccttaatgggtatctggacaagcacaaggacgaagttgatagggcgagtgctgacagcatgataacaaaccttctcaaacacattgccaaggcacaggagctctataagaattcgtctgcgcttcgtgcacaaggtgcacagattgacactgccttcagctcatactattggctttacaaggcaggcgtgactccagaaaccttcccgacggtgtcacagttcctcttcgagctagggaaacagccaagaggtaccaagaaaatgaagaaggctctgctgagcaccccaatgaaatgggggaagaaactttatgagctctttgccgacgattctttccagcaaaacaggatctacatgcatcctgccgtgcttacagctggcagaatcagtgaaatgggagtctgctttgggacaatccctgtggccaatcctgatgatgctgcccaaggatctggacacactaagtctattctgaacctccggactaacaccgagaccaacaatccgtgtgccaagaccatcgtcaagctgtttgaaattcagaaaacagggttcaatatccaggacatggacatagtggcctctgagcacctgctgcaccagtctcttgttggcaagcaatctccattccagaacgcctacaacgtcaagggcaatgccaccagtgccaacattatctaa

SEQ ID NO: 2973 - RNA, 1449 nt, synthetic construct
  misc_feature 1..1449: note = derived and/or modified CDS sequence (wt) from CCHFV(SPU 92/01)__KC880335.1__N
  source 1..1449: mol_type = other RNA
atggaaaacaaaatagaggtgaataacaaagatgagatgaacaagtggttcgaagagttcaaaaagggaaatggacttgtggacaccttcacaaactcctattccttttgtgagagtgttccaaatttggacaagtttgtgttccaaatggccagtgccactgatgatgcacaaaaggattctatctacgcgtctgctctggtggaggcaacaaagttttgtgcacctatatatgagtgtgcgtgggttagctccactggcattgtgaagaggggacttgaatggttcgaaaaaaatgcgggcaccattaagtcctgggatgaaagttatactgagctaaaagttgacgtcccgaaaatagaacaacttgccaattaccaacaagctgccttaaaatggagaaaggacataggtttccgtgtcaatgcaaacacagctgctttgagcaacaaagtccttgcagagtacaaagttcctggcgagattgtgatgtctgtcaaagagatgctgtcagacatgattcggagaaggaaccaaattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgcaacaggccttgccaagcttgcagagactgaaggaaagggagtttttgacgaagccaaaaagaccgtggaggccctcaatgggtatctggacaagcacaaggacgaagttgacagggcgagtgctgacagcatgataacaaaccttctcaagcacattgccaaggcacaggagctttataagaattcgtctgcactccgtgcacaaggtgcacagattgacactgctttcagctcatactattggctttacaaagctggcgtgaccccagaaaccttcccgacggtgtcgcagttcctcttcgagctagggaagcagccaagaggtaccaagaaaatgaagaaggctctgctgagcaccccaatgaagtgggggaagaaactttatgagctctttgccgacgattctttccagcagaacaggatctacatgcaccctgccgtgcttacagctggcagaatcagtgaaatgggagtctgctttgggacaatccccgtggccaatcctgatgatgctgcccaaggatctggacataccaagtccattctcaacctccagactaacaccgagaccaacaatccatgtgccaggaccattgtcaagctgtttgaaattcagaaaacagggttcaacattcaggacatggacatagtggcctctgagcacttgctacaccagtctcttgttggcaagcaatctccattccagaatgcctacaacgtcaagggcaatgccaccagtgttaacattatctaa

SEQ ID NO: 2974 - RNA, 1449 nt, synthetic construct
  misc_feature 1..1449: note = derived and/or modified CDS sequence (wt) from CCHFV(SRR)__KU707901.1__N
  source 1..1449: mol_type = other RNA
atggagaataaaatcgaggtgaataacaaagatgagatgaacaagtggtttgaagagttcaagaaaggaaatggacttgtggacactttcacaaactcctactccttttgtgagagcgttccaaatctggatagatttgtatttcagatggctggtgctactgatgatgcacaaaaggattccatctacgcatctgctctggtggaggcaactaaattttgtgcacccatatatgaatgtgcctgggttagctccactggtattgtgaaaaagggactagagtggttcgaaaaaaatgcaggaaccattaaatcttgggatgaaagctacactgagctgaaagttgaagtccccaaaatagagcagcttgccaattaccaacaggctgctctcaagtggaggaaagacataggcttccgtgtcaatgcaaatacggcagccttaagccacaaagtccttgcagaatataaagttcctggcgaaattgtaatgtctgtcaaagagatgttgtcagatatgattagaagaaggaacttgattctcaacagaggtggcgatgaaaacccacgaggcccagtgagccgtgaacatgtggaatggtgcagggaatttgtcaaaggcaagtacatcatggctttcaacccaccttggggggatatcaacaagtcaggccggtcaggaatagcacttgttgcaacaggccttgccaagcttgcagaaactgaagggaagggagtgtttgatgaagcaaagaagactgtggaggctctcaacgggtacctggacaagcataaggacgaggttgacaaagcaagtgctgacaacatgataacaaaccttcttaaacacatcgccaaggcacaggagctttacaaaaactcgtctgcacttcgtgcacagggtgcacagattgacactgctttcagctcatactactggctctacaaggccggcgtgactccagaaaccttcccaactgtctcacagttccttttcgagttagggaagcaaccaaggggtaccaagaaaatgaagaaagcactcttgagcactccaatgaggtgggggaagaagctctatgagctctttgctgatgattctttccagcagaacaggatctacatgcatcctgctgtgttgacagctggcagaatcagtgagatgggtgtttgctttggaacaatccctgtggccaatcctgatgatgccgcccagggatccggacacaccaagtccattcttaaccttcgaacaaacaccgagaccaacaatccatgtgccaagacaattgtcaagttgtttgaaattcaaaaaacagggtttaacatacaggacatggacattgtagcctctgagcacctgctgcaccagtctcttgtcggcaagcagtctccattccaaaatgcctacaatgttaaggggaacgctacaagtgccaacatcatctaa

SEQ ID NO: 2975 - RNA, 1449 nt, synthetic construct
  misc_feature 1..1449: note = derived and/or modified CDS sequence (wt) from CCHFV(STV/HU29223)__AF481802.1__N
  source 1..1449: mol_type = other RNA
atggaaaacaagatcgaggtgaacagcaaagatgaaatgaacaaatggtttgaagagtttaaaaagggaaatggacttatggatactttcacaaactcctactccttttgtgagaatgtaccaaatctggataagtttgtgttccagatggccagcgccactgatgatgcacagaaggactccatctatgcatcggctctggtagaagcaaccaaattctgtgcacccatatatgaatgtgcatgggttagctctaccggcattgtgaagaaggggcttgagtggttcgagaagaattcaggaaccatcaaatcctgggatgagaactatgctgaactgaaggttgatgttcccaaaatagaacaacttgccaattaccaacaggctgctctcaagtggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatctaattctcaataggggcggtgatgaaaatctgcgcggcccagtgagccgtgaacatgtggagtggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagccaagaagaccgtggaggctctcaatgggtatttggacaagcacagagacgaagttgacaaagcaagtgctgacagcatgataacaaacctcctgaagcacattgccaaagcacaagagctttataaaaattcatctgctcttcgtgcacaaggtgcacagattgacactcctttcagctcgttttactggctttacaaggccggtgtgactccagagaccttcccaactatctcacagttccttttcgaactggggaagcaaccaagggggaccaagaaaatgaaaaaggcactcctgagcactccaatgaagtgggggaagaaactttatgagctctttgctgatgactctttccagcagaacagaatctacatgcaccctgctgtgttgacagccggcagaatcagtgaaatgggtgtctgctttggaacaatccctgttgccaatcctgatgacgctgctcagggatctggacacaccaagtccattctcaaccttcggacaagcacagagaccaacaatccatgcgccaagacaattgtcaaattgtttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctga

SEQ ID NO: 2976 - RNA, 1449 nt, synthetic construct
  misc_feature 1..1449: note = derived and/or modified CDS sequence (wt) from CCHFV(TAJ/HU8966)__AY049083.2__N
  source 1..1449: mol_type = other RNA
atggagaataaaatcgaggtgaacaacaaagatgagatgaacaagtggtttgaagagttcaaaaaaggaaatggacttgtggacactttcacaaactcctactccttttgtgagagtgttccaaatctggacagatttgtatttcagatggccagtgctactgatgatgcacaaaaggattccatctacgcatctgctctagtggaggcaaccaaattttgcgcacccatatacgagtgtgcttgggttagctccactggtattgtgaagaagggactggagtggttcgagaaaaatgcaggaaccattaaatcttgggatgaaagctacactgagctgaaagttgaggtccctaaaatagagcagcttgccaattaccaacaggctgctctaaaatggagaaaggacataggtttccgtgtcaatgcaaatacggcagccttaagccataaggtccttgcagaatacaaagtccctggtgaaattgtaatgtctgtcaaagaaatgttgtcagatatgattagaaggaggaacttaattctcaacagaggtggcgatgaaaatccacgaggcccggtgagccgtgaacatgtggaatggtgcagggagtttgtcaaaggcaagtacatcatggctttcaacccaccttggggcgatatcaacaagtcaggtcggtcaggaatagcacttgttgcaacaggccttgccaagcttgcagagactgaagggaaaggagtgtttgatgaagcaaaaaagactgtggaggctctcaacgggtacctagacaagcataaggacgaggttgacaaagcaagtgccgacaacatgataacaaaccttcttaaacacatcgccaaggcacaggagctttacaagaactcgtctgcacttcgtgcacagggtgcacagattgacactgctttcagctcatactactggctctacaaggccggcgtgactccagaaaccttcccaactgtctcacagttccttttcgaactggggaagcaaccaaggggtaccaagaaaatgaagaaggcactcttgagcactccaatgaagtgggggaagaagctctatgagctctttgctgatgattctttccagcagaacaggatctacatgcatcctgctgtgttgacagccggcagaatcagtgagatgggtgtctgctttggaacaatccctgtggccgatcctgatgatgccgcccagggatccggacacaccaagtccattcttaatcttcgaacaaacaccgagaccaacaatccatgtgctaagacaattgtcaagttgtttgaaattcaaaaaacagggtttaacatacaggacatggacattgtagcctctgagcacctgctgcaccagtctcttgttggcaagcagtctccattccaaaatgcctacaatgtcaagggcaacgctacaagtgctaacatcatctga

SEQ ID NO: 2977 - RNA, 1449 nt, synthetic construct
  misc_feature 1..1449: note = derived and/or modified CDS sequence (wt) from CCHFV(TAJ/HU8975)__AY297692.2__N
  source 1..1449: mol_type = other RNA
atggagaataaaatcgaggtgaataacaaagatgagatgaacaagtggtttgaagaattcaagaaaggaaatggacttgtggacactttcacaaactcctactccttttgtgagagtgttccaaatctggacaggtttgtgtttcagatggccagtgccaccgatgatgcacaaaaggattccatctacgcatcagctctggtggaagcaaccaaattttgcgcacccatatacgagtgtgcctgggttagctccactggcattgtgaagaagggactggagtggtttgagaagaatgcaggaaccattaaatcttgggatgaaagctatattgagctgaaagttgaggtccccaaaatagaacagcttgccaattaccaacaggctgctctcaagtggaggaaggacataggttttcgtgtcaatgcaaatacggcagccttaagccacaaagtcctcgcagagtacaaagtccctggtgaaattgtaatgtctgtcaaagaaatgctgtcagatatgattagaagaaggaacttgattctcaacagaggtggagatgaaaacccacgaggcccagtgagccgtgaacatgtggagtggtgtagggaatttgtcaaaggcaagtacatcatggctttcaacccgccttggggggacatcaacaagtcaggccggtcaggaatagcacttgttgcaacaggccttgccaagctcgcagagactgaggggaaaggagtgtttgatgaagcaaaaaagactgtagaggctctcaacgggtacctggataaacacaaggacgaagttgacaaagcaagtgccgacaacatgataacaaaccttctcaaacacattgctaaggcacaggagctttacaaaaactcgtctgcacttcgtgcacaaggtgcacagattgacactgccttcagctcatattactggctctacaaggctggtgtgactccagaaaccttcccgactgtctcacagttccttttcgaactggggaaacaaccaaggggtaccaagaaaatgaagaaggcactcttaagcaccccaatgaagtgggggaagaagctttatgagctttttgctgatgactctttccagcaaaacaggatctatatgcaccctgctgtgttgacagccggtagaatcagtgagatgggtgtctgctttggaacaatccctgtggccaatcccgatgatgctgcccagggatctggacacaccaagtccattcttaacctgcgaacaaacaccgagaccaacaatccgtgtgccaagacaattgtcaagttgtttgaaattcaaaaaacagggtttaacatacaagacatggacattgtagcctctgaacacctgctgcaccagtcccttgtcggcaagcagtctccattccaaaatgcctacaatgtcaagggcaatgccaccagtgccaacattatctga

SEQ ID NO: 2978 - RNA, 1449 nt, synthetic construct
  misc_feature 1..1449: note = derived and/or modified CDS sequence (wt) from CCHFV(TAJ/HU8978)__AY297691.2__N
  source 1..1449: mol_type = other RNA
atggagaataaaatcgaggtgaacaacaaagatgagatgaacaagtggtttgaagagttcaaaaaaggaaatggacttgtggacactttcacaaactcctactccttttgtgagagtgttccaaatctggacagatttgtatttcagatggccggtgctactgatgatgcacaaaaggattccatctacgcatctgctctagtggaggcaaccaaattttgcgcacccatatacgagtgtgcttgggttagctccactggtattgtgaagaagggactggagtggttcgagaaaaatgcaggaaccatcaaatcttgggatgaaagctacactgagctgaaagttgaggtccctaaaatagagcagcttgccaattaccaacaggctgctctaaaatggagaaaggacataggtttccgtgtcaatgcaaatacggcagccttaagccataaggtccttgcagaatacaaagttcctggtgaaattgtaatgtctgtcaaagaaatgttgtcagatatgattagaaggaggaacttatttctcaacagaggtggcgatgaaaatccacgaggcccggtgagccgtgaacatgtggaatggtgcagggagtttgtcaaaggcaagtacatcatggctttcaacccaccttggggcgatatcaacaagtcaggtcggtcaggaatagcacttgttgcaacaggccttgccaagcttgcagagactgaagggaaaggagtgttcgatgaagcaaaaaggactgtggaggctctcaacgggtacctagacaagcataaggacgaggttgacaaagcaagtgccgacaacatgataacaaaccttcttaaacacatcgccaaggcacaggagctttacaaaaactcgtctgcacttcgtgcacagggtgcacagattgacacttctttcagctcatactactggctctacaaggccggtcggactccagaaaccttcccaactgtctcacagttccttttcgaactagggaagcaaccaaggggtaccaagaaaatgaagaaggcactcttgagcactccaatgaagtgggggaagaagctctatgagctctttgctgatgattctttccagcagaacaggatttacatgcatcctgctgtgttgacagccggcagaatcagtgagatgggtgtctgctttggaacaatccctgtggccaatcctgatgatgccgcccagggatccggacacaccaagtccattcttaatcttcgaacaaacaccgagaccaacaatccatgtgccaagacaattgtcaagttgtttgaaattcaaaaaacagggtttaacatacaggacatggacattgtagcctctgagcacctgctgcaccagtctcttgttggcaagcagtctccattccaaaatgcctacaatgtcaagggcaacgctacaagtgctaacatcatctga

SEQ ID NO: 2979 - RNA, 1449 nt, synthetic construct
  misc_feature 1..1449: note = derived and/or modified CDS sequence (wt) from CCHFV(Uzbek/TI10145)__AF481799.1__N
  source 1..1449: mol_type = other RNA
atggagaataaaatcgaggtgaataacaaagatgagatgaacaagtggtttgaagagttcaagaaaggaaatggacttgtggacactttcacaaactcctactccttttgtgagagtgttccaaacctggacaggtttgtgtttcagatggccagtgccaccgacgatgcacaaaaggattccatttacgcgtcagctctggtggaagcaaccaaattttgtgcacccatatacgagtgtgcctgggttagctccactggcattgtgaagaagggactggagtggttcgaaaagaatgcaggaaccattaaatcctgggatgaaagctacactgagctgaaagttgaggtccccaaaatagaacagcttgccgattaccaacaggctgctctcaagtggaggaaggacataggttttcgtgtcaatgcaaatacggcagccttaagccacaaagtcctcgcagagtataaagtccctggtgaaattgtaatgtctgtcaaagaaatgttgtcagatatgattagaagaaggaacttgattctcaacagaggtggcgatgaaaacccgcgaggcccagtgagccgtgaacatgtggagtggtgcagagaatttgtcaaaggtaagtacatcatggctttcaacccgccctggggggacatcaacaagtcaggccgatcaggaatagcacttgttgcaacaggccttgccaagctcgcagagactgaggggaagggagtgtttgatgaagcaaaaaagactgtagaggctctcaacggatacttggacaaacacaaggacgaagttgacaaagcaagtgccgacaacatgataacaaaccttctcaaacacattgccaaggcacaggagctttacaaaaactcgtctgcacttcgtgcacagggtgcacagattgatactgctttcagctcatactactggctctacaaggccggcgtgactccagaaaccttcccgactgtctcacagttccttttcgaactagggaaacaaccaaggggtaccaagaaaatgaagaaggcacttttgagcaccccaatgaagtgggggaagaagctttatgagctttttgctgatgactctttccaacaaaacaggatctacatgcaccctgccgtgttgacagctggcagaatcagtgagatgggtgtctgctttggaacaatccctgtggccaatcccgatgatgctgcccagggatctggacacaccaagtccatccttaacctacggacaaacaccgagaccaacaatccgtgtgccaagacaattgtcaagttgtttgaaattcaaaaaacagggtttaacatacaagacatggacattgtggcctctgaacacctgctgcaccagtcccttgttggcaagcagtctccattccagaatgcctacaatgtcaagggcaatgccaccagtgccaacatcatctga

SEQ ID NO: 2980 - RNA, 1449 nt, synthetic construct
  misc_feature 1..1449: note = derived and/or modified CDS sequence (wt) from CCHFV(ROS/TI28044)__AY277672.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagcgccactgatgatgcacagaaggactccatctatgcatcggctctggtggaagcaaccaagttctgtgcacccatatatgaatgtgcctgggtcagctctaccggcattgtgaagaaggggcttgagtggttcgagaagaattcaggaaccatcaaatcctgggatgagaactatgctgagctgaaggttgatgttcccaaaatagaacaactcgccaattaccagcaggctgctctcaagtggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatctaattctcaacaggggcggtgatgaaaatccgcgcggcccagtgagccgtgaacatgtggagtggtgcagggaatttgtcaaaggcaagtacatcatggccttcaatccaccttggggggacatcaacaaaccaggccgttcggggatagcacttgttgcaacaggccttgccaagcttgcagagaccgaggggaaaggagtttttgacgaagccaagaagaccgtggaggctctcaatgggtatttggacaagcacagggacgaagttgacaaagcaagtgctgacagcatgatagcaaacctcctgaagcacattgccaaagcacaagagctttataaaaattcatctgctcttcgtgcacaaggtgcacagattgacacccctttcagctcgttttactggctttacaaggccggtgtgactccagagaccttcccaactatctcacagttccttttcgaactggggaagcaaccaagggggaccaagaaaatgaaaaaggcactcctgagcactccaatgaagtgggggaagaaactttatgagctctttgctgatgactctttccagcagaacagaatctacatgcaccctgctgtgttaacagccggtagaatcagtgaaatgggtgtctgctttggaacaatccctgttgccaatcctgatgacgctgctcagggatctggacataccaagtccattctcaaccttcggacaagcacagagaccaacaatccatgcgccaagacaattgtcaaattgtttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 2981 - RNA, 1449 nt, synthetic construct
  misc_feature 1..1449: note = derived and/or modified CDS sequence (wt) from CCHFV(7001)__AF415236.1__N
  source 1..1449: mol_type = other RNA
atggagaacaaaatcgaggtgaataacaaagatgagatgaataagtggtttgaagagttcaagaaaggaaatggacttgtggacactttcacaaactcctactccttttgtgagagtgttccaaatctggacagatttgtatttcagatggccagtgccactgatgatgcacaaaaggattccatctacgcatcagctctggtggaagcaactaagttttgcgcacccatatacgagtgtgcctgggttagctccactggtattgtgaagagaggattggagtggttcgaaaaaaatgcaggaaccattaaatcttgggatgaaagctacactgaactgaaggttgaggttcccaaaatagaacagcttgccgattaccaacaggctgctctcaagtggaggaaggacataggtttccgtgtcaatgcaaatacgacagccttaagccacaaggtcctcgcagagtacaaagtccctggtgaaattgttatgtctgtcaaagaaatgttgtcagatatgattagaagaaggaacttgattctcaacagaggtggcgatgaaagtccacgaggcccagtgagccgtgaacatgtggagtggtgcagggaatttgtcaaaggcaagtacatcatggctttcaacccgccttggggggacatcaacaagtcaggccggtcaggaatagcacttgttgcaacaggccttgctaagcttgcagagactgaggggaagggagtgtttgatgaagcaaaaaagactgtggaggctctcaacgggtacttgaacaaacataaggacgaggttgacaaagcaagtgccgacagcatgataacaaaccttcttaaacacattgccaaggcacaggagctttacaaaaactcgtctgcacttcgtgcacagggtgcacagattgatactgctttcagctcatactactggctctacaaggccggcgtgactccagaaaccttcccgactgtctcacagttcctttttgaactagggaagcaaccaaggggcaccaagaaaatgaagaaggcactcttgagcaccccattgaaatggggtaagaagctttatgagctctttgctgatgattccttccagcagaacaggatctacatgcaccctgctgtgctgacagctggcagaattagtgagatgggtgtctgctttgggacaatccctgtggccaaccctgatgatgctgcccagggatctggacacaccaagtccattcttaaccttcgtacaaataccgagaccaacaatccgtgtcccaagacaattgtcaagttgtttgaaattcaaaaaacagggttcaacatacaagacatggacattgtggcttctgagcacctgctacaccaatcccttgtcggcaaacagtctccattccaaaatgcctacaatgtcaagggcaacgccaccagtgccaacatcatctga

SEQ ID NO: 2982 - RNA, 1449 nt, synthetic construct
  misc_feature 1..1449: note = derived and/or modified CDS sequence (wt) from CCHFV(79121M18)__GU477494.1__N
  source 1..1449: mol_type = other RNA
atggagaacaaaatcgaggtgaataacaaagatgagatgaataagtggtttgaagagttcaagaaaggaaatggacttgtggacactttcacaaactcctactccttttgtgagagtgttccaaatctggacagatttgtatttcagatggccagtgccactgatgatgcacaaaaggattccatctacgcatcagctctggtggaagcaactaagttttgcgcacccatatacgagtgtgcctgggttagctccactggtattgtgaagagaggattggagtggttcgaaaaaaatgcaggaaccattaaatcttgggatgaaagctacactgaactgaaggttgaggttcccaaaatagaacagcttgccgattaccaacaggctgctctcaagtggaggaaggacataggtttccgtgtcaatgcaaatacgacagccttaagccacaaggtcctcgcagagtacaaagtccctggtgaaattgttatgtctgtcaaagaaatgttgtcagatatgattagaagaaggaacttgattctcaacagaggtggcgatgaaagtccacgaggcccagtgagccgtgaacatgtggagtggtgcagggaatttgtcaaaggcaagtacatcatggctttcaacccgccttggggggacatcaacaagtcaggccggtcaggaatagcacttgttgcaacaggccttgctaagcttgcagagactgaggggaagggagtgtttgatgaagcaaaaaagactgtggaggctctcaacgggtacttgaacaaacataaggacgaggttgacaaagcaagtgccgacagcatgataacaaaccttcttaaacacattgccaaggcacaggagctttacaaaaactcgtctgcacttcgtgcacagggtgcacagattgatactgctttcagctcatactactggctctacaaggccggcgtgactccagaaaccttcccgactgtctcacagttcctttttgaactagggaagcaaccaaggggcaccaagaaaatgaagaaggcactcttgagcaccccattgaaatgggggaagaagctttatgagctctttgctgatgattccttccagcagaacaggatctacatgcaccctgctgtgctgacagctggcagaattagtgagatgggtgtctgctttgggacaatccctgtggccaaccctgatgatgctgcccagggatctggacacaccaagtccattcttaaccttcgtacaaataccgagaccaacaatccgtgtgccaagacaattgtcaagttgtttgaaattcaaaaaacagggttcaacatacaagacatggacattgtggcttctgagcacctgctacaccaatcccttgtcggcaaacagtctccattccaaaatgcctacaatgtcaagggcaacgccaccagtgccaacatcatctga

SEQ ID NO: 2983 - RNA, 1449 nt, synthetic construct
  misc_feature 1..1449: note = derived and/or modified CDS sequence (wt) from CCHFV(AP92)__DQ211638.1__N
  source 1..1449: mol_type = other RNA
atggagaacaaaatcgaggtgaacagcaaagacgatctgaacaagtggtttgaggagttcaagaaaggaaatgggcttgtggacaccttcacaaactcatattctttttgtgaaaatgtgccgaacttggacagatttgtgtatcagatggccagtgcaaccgatgatgcacagaaggactctatatatgcatctgctcttgttgaagcaaccaagtactgtgcaccaatatatgagtgtgcctgggtcagctctacaggcattgtaaagaaaggtttggagtggtttgaaaagaacacgagcactatcaaatcctgggacgagagctacactgagctgaaggttgacattcccaaaatagagcagctctctagttatcagcaggcagccctcaagtggagaaaggacataggtttccgcatcaatgctaacacaacagcgctgagcaacaaagtgcttgcagagtacaaggttccaggagagatcttggtgcctgtcaaagagatgctgtcagacatgataaggagaaggaacattatccttaacagaggcagcgatgagaatccacgaggcccagtaagtcatgagcacattgagtggtgcagggagttcatcaagggaaagtacattatggccttcaatccaccttggggtgacatcaacaaatcaggtcgctccgggattgcacttgtcgcaaccggtcttgccaagctggcagagactgaaggtaaaggagtcttcgaagaagccaaaaagactgtggaagcactcaaggactaccttgacaaacacagagatgaagtcgacaagacaagtgctgacaacatggtgacaagccttttgaaacatattgccaaggctcaggaactctacaagaactcatctgcacttcgtgctcagggtgcacaaattgacactcctttcagctcgttctactggctctacaaggcaggggtcactccagagacgttccccactgtttcccagtttctctttgagcttggaaagcagccaaggggcaccaagaaaatgaagaaagctctgctcagcactcccatgaagtggggaaagaagctctatgagctctttgcagatgactctttccagcagaacaggatctacatgcaccctgctgtgctgacagctggtaggatcagcgaaatgggtgtctgctttgggacaattcctgtagccaacccagatgatgcagcccagggatctggacacaccaagtccattctaaatctaaggacaaacactgagtccaacaatccgtgtgccaggaccattgtcaagcttttcgaaattcagaagacgggctttgacataaaggacatggacatcgtggcctctgagcatctgctgcaccaatccctggttgggaagcagtcgcccttccagaatgcctacaatgtcaagggcaatgccaccagtgccaacatcatctag

SEQ ID NO: 2984 - RNA, 1449 nt, synthetic construct
  misc_feature 1..1449: note = derived and/or modified CDS sequence (wt) from CCHFV(ArD15786)__DQ211640.1__N
  source 1..1449: mol_type = other RNA
atggagaacaaaatcgaagtgaacaacaaagatgagctgaacaaatggtttgaggagttcaagaaaggaaacgggcttgtggatactttcacaaactcctattctttctgtgagaacgtgccgaaccttgacaggtttgtattccagatggctggtgcaaccgatgatgcacaaaaagactccatctatgcatctgccctggttgaggccaccaagtactgtgctcccatatatgaatgtgcctgggttagctccacaggtatagtgaagagaggccttgagtggtttgaaaaaaacacaggaaccattaagtcttgggatgagagctatactgagctgaaagtggatgtgcccaaaattgaacagcttgccaactatcagcaggccgccctcaagtggaggaaggacataggcttccgcgttaatgcaaacacagcggccctaagcaacaaagtcctctctgagtacaaggttcctggtgagattgtgatgtctgtcaaagagatgctttcagacatgattagaaggaggaacctgatccttaacagaggaggtgatgagaacccaagaggcccagtaagcaaggagcacatagaatggtgcagggagtttgtcaagggcaaatatataatggccttcaatccaccctggggtgatgtcaacaagtccggccgctcaggaatagctctagttgctacaggtcttgccaaacttgcagaaacagaaggaaagggagtttttgaggaggccaagaagacagtggaggccctcaaggagtaccttgacaaacacaaagatgaggtggacaaggctagtgctgacagcatggtaacaaacctcctcaagcacatcactaaggcccaggaactctacaaaaactcatcagcactgagagcacagggtgcacagattgacacccctttcagctccttctactggctctataaagcgggcgtgactccagaaaccttccccaccgtctctcaattcctctttgagctgggaaagcagccaagaggcactaaaaaaatgaagaaggcacttctgagcaccccaatgaaatggggaaagaagctttatgagctcttcgctgatgactctttccagcaaaacaggatctacatgcaccctgctgtgctgacagctggcagaattagtgagatgggtgtttgctttggaaccatccctgttgccaatccagacgatgcagcccagggctcaggtcacaccaagtcaattctgaacctccgaacaaatagtgaaactaacaatccttgtgctaaaacgattgtcaaacttttcgaagttcaaaaaacaggattcaacatacaggacatggatattgttgcctctgagcacctgctgcaccagtctcttgttggcaagcaatccccgttccaaaatgcttacaacgtcaaaggcaatgccaccagtgccaacattatctaa

SEQ ID NO: 2985 - RNA, 1449 nt, synthetic construct
  misc_feature 1..1449: note = derived and/or modified CDS sequence (wt) from CCHFV(ArD39554)__DQ211641.1__N
  source 1..1449: mol_type = other RNA
atggaaaacaaaatcgaggtgaataacaaagatgagatgaacaaatggtttgaagagttcaaaaaaggaaatggacttgtggataccttcacaaactcctattccttttgcgagagtgttccaaatttggacaagtttgtgttccaaatggccagtgccaccgatgatgcacaaaaggattccatctacgcgtctgctctggtggaggcaacaaaattttgtgcacctatatatgagtgtgcgtgggttagctccactggcattgtgaaaaggggacttgaatggttcgaaaaaaatgcgggcaccattaagtcttgggatgaaagttatactgagctaaaagttgatgtcccaaaaatagaacaacttgccaattaccaacaagctgccttgaaatggagaaaggacataggtttccgtgtcaatgcaaacacagcggctctgagcaacaaagtcctcgcagagtacaaagttcctggcgagattgtaatgtctgtcaaagagatgctgtcagacatgattcggagaagaaaccaaattctaaacaggggtggtgatgagaatccacgtggccctgtgagccgtgagcatgtggactggtgcagggagtttgtcaaaggcaaatacatcatggccttcaacccaccatggggggatatcaacaagtcaggccgttcaggaatagcacttgtcgcaacaggccttgccaagcttgcagagactgaaggaaagggagtttttgacgaagccaaaaagaccgtagaggctctcaatggatatctggacaagcataaggacgaagttgacaaggcgagtgctgacagtatgataacaaaccttctcaagcacattgccaaggcacaggagctctacaagaattcgtctgcactccgtgcacaaggtgcccagattgacactgccttcagctcatactactggctttacaaagctggcgtgaccccagaaaccttcccgacggtgtcgcagttcctctttgagctagggaagcagccaagaggtactaagaaaatgaagaaggctctgctgaccaccccaatgaagtggggaaagaaactttatgaactctttgccgacgattctttccagcagaacaggatctacatgcaccctgccgtgcttacagctggcagaatcagtgaaatgggagtctgctttgggacaatccccgtggccaatcctgatgatgctgcccaaggatctggacataccaagtctattctcaacctccggactaacaccgaaaccaacaatccatgtgccaggaccattgtcaagctgtttgaaatccagaaaacagggttcaacattcaggacatggacatagtggcctctgagcacttgctacatcagtctcttgttggcaagcaatctccattccagaacgcctacaacgtcaagggcaatgccaccagtgctaacattatctaa

SEQ ID NO: 2986 - RNA, 1449 nt, synthetic construct
  misc_feature 1..1449: note = derived and/or modified CDS sequence (wt) from CCHFV(BT958)__EF123122.1__N
  source 1..1449: mol_type = other RNA
atggaaaacaaaatcgaggtgaataataaagatgagatgaacaggtggtttgaagagttcaagaaagagaatgggcttgtagacactttcacaaactctcattccttttgtgaaagtgtcccaaatctggacaaatttgtgttccagatggctagtgccaccgatgatgcacaaaaggattccatctatgcagctgcactggtggaagcaaccaaattctgtgcacctatatacgagtgtgcttgggttagctccactggcatcgtcaagaaggggctagaatggtttgaaaaaaatgcaggaaccattaaatcttgggatgagagttataccgagttgaaggttgaagttcccaaaatagaacagctatctaattaccagcaggctgctctcaagtggaggaaggacataggcttccgtgtcaatgcaaatacggcaaccctgagccataaagtccttgcagagtataaagtacctggtgagattgtgatgtctgtcaaagaaatgttatcagacatgatcagaaggagaaatctgattctcaacagaggtggtgatgagaacccacgtggcccagtgagccgtgaacatgtggagtggtgcagggaatttgttaaaggcaagtacataatggcctttaaccctccctggggggacatcaacaagtcaggacgttcaggaatagcactagttgcaacaggccttgccaagcttgcagaggctgaggggaagggagtgtttgatgaagctaagaagactgtagaggctcttaacggatatctagacaaacataaggacgaagttgacaaatcaagtgctgacagcatgataacaaaccttctcaagcacattgcgaaagcgcaagagctctataggaattcttctgcacttcgtgcacagggtgcacagattgacactgctttcagctcatattactggctctacaaggcaggtgtgactccagaaaccttcccaactgtctcacagttccttttcgagctggggaagcaaccaaggggcactaagaaaatgaagaaggcactcctgagcacaccaatgaagtgggggaagaagctttatgagctctttgctgatgattctttccagcagaacaggatttacatgcaccctgctgtgctaacagctggcagaatcagtgagatgggtgtctgctttgggacaatccctgtggccaatccagatgatgctgccctagggtctggacacaccaagtctattcttaatcttcgaacaagcaccgaggcaaacaatccatgtgcaaagacaattgtcaagttgtttgagattcagaaaaaaggatttgtaataaaagatatggacattgtggcctctgagcatctgctacaccaatcccttgttggtaagcagtctccattccagaatgcttacaatgtcaagggtaacgccaccagtgctaacatcatctga

SEQ ID NO: 2987 - RNA, 1449 nt, synthetic construct
  misc_feature 1..1449: note = derived and/or modified CDS sequence (wt) from CCHFV(C-68031)__DQ211642.1__N
  source 1..1449: mol_type = other RNA
atggagaataaaatcgaggtgaataacaaagatgaaatgaacaagtggtttgaagagttcaagaaaggaaatggacttgtggatactttcacaaactcctactccttttgtgagagtgttccaaatctggaaaggtttgtgtttcagatggccagtgccaccgatgatgcacaaaaggattccatctacgcatcagctctggtggaagcaaccaaattttgtgcacccatatacgagtgtgcctgggttagctccactggcattgtgaagaagggactggagtggttcgaaaaaaatgcaggaaccattaaatcttgggatgaaagctacattgagctgaaagttgaggtccctaaaatagaacagcttgccaattaccaacaggctgctctcaagtggaggaaggacataggttttcgtgtcaatgcaaatacggcagccttaagccacaaggtccttgcagagtacaaggtccctggcgaaattgtaatgtccgtcaaagaaatgttgtcagatatgattagaagaaggaacttgattctcaacagaggtggcgatgaaaatccacgaggcccagtgagccgtgaacatgtggagtggtgcagggaatttgtcaaaggcaagtacatcatggctttcaacccgccctggggggacatcaacaagtcaggccgatcaggaatagcacttgttgcaacaggccttgccaagctcgcagagactgaggggaagggagtgtttgatgaagccaaaaagactgtagaggctctcaacgggtaccttgacaaacacaaggacgaagttgacaaagcaagtgccgacaacatgataacaaaccttctcaaacacattgctaaggcacaagagctttacaaaaactcgtctgcacttcgtgcacagggtgcacagattgacactgctttcagctcatactactggctctacaaggccggcgtgactccagaaaccttcccgactgtctcacagttcctttttgagctagggaaacaaccaaggggtaccaagaaaatgaagaaggcactcttgagcaccccaatgaagtggggtaagaagctttatgagctctttgctgatgactcattccagcaaaacaggatctacatgcaccctgccgtgttgacagctggcagaatcagtgagatgggtgtctgctttggaacaatccctgtggccaatcccgatgatgctgcccagggatctggacacaccaagtccattcttaacctacggacaaacaccgaaaccaacaatccgtgtgccaagacaattgtcaagttgtttgaaattcaaaaaacaggatttaatatacaagacatggacattgtagcctctgagcacctgctgcaccaatcccttgtcggcaagcagtctccattccagaatgcctacaacgtcaagggcaatgccaccagtgccaacatcatctga

SEQ ID NO: 2988 - RNA, 1449 nt, synthetic construct
  misc_feature 1..1449: note = derived and/or modified CDS sequence (wt) from CCHFV(China)__AF354296.1__N
  source 1..1449: mol_type = other RNA
atggagaataaaatcgaggtgaataacaaagatgaaatgaacaagtggtttgaagagttcaagaaaggaaatggacttgtggatactttcacaaactcctactccttttgtgagagtgttccaaatctggaaaggtttgtgtttcagatggccagtgccaccgatgatgcacaaaaggattccatctacgcatcagctctggtggaagcaaccaaattttgtgcacccatatacgagtgtgcctgggttagctccactggcattgtgaagaagggactggagtggttcgaaaaaaatgcaggaaccattaaatcttgggatgaaagctacactgagctgaaagttgaggtccctaaaatagaacagcttgccaattaccaacaggctgctctcaagtggaggaaggacataggttttcgtgtcaatgcaaatacggcagccttaagccacaaggtccttgcagagtacaaagtccctggcgaaattgtaatgtccgtcaaagaaatgttgtcagatatgattagaagaaggaacttgattctcaacagtggtggcgatgaaaatccacgaggcccagtgagccgtgaacatgtggagtggtgcagggaatttgtcaaaggcaagtacatcatggctttcaacccgccctggggggacatcaacaagtcaggccgatcaggaatagcacttgttgcaacaggccttgccaagctcgcagagactggggggaagggagtgtttgatgaagccaaaaagactgtagaggctctcaacgggtaccttgacaaacacaaggacgaagttgacaaagcaagtgccgacaacatgataacaaaccttctcaaacacattgctaaggcacaagagctttacaaaaactcgtctgcacttcgtgcacagggtgcacagattgacactgctttcagctcatactactggctctacaaggccggcgcgactccagaaaccttcccgactgtctcacagtttctttttgagctagggaaacaaccaaggggtaccaagaaaatgaagaaggcactcttgagcaccccaatgaagtggggtaagaagctttatgagctctttgctgatgactcattccagcaaaacaggatctacatgcaccctgccgtgttgacagctggcagaatcagtgagatgggtgtctgctttggaacaatccctgtggccaatcccgatgatgctgcccagggatctggacacaccaagtccattcttaacctacggacaaacaccgaaaccaacaatccgtgtgccaagacaattgtcaggttgtttgaaattcaaaaaacaggatttaatatacaagacatggacattgtagcctctgagcacctgctgcaccaatcccttgtcggcaagcagtctccattccagaatgcctacaacgtcaagggcaatgccaccagtgccaacatcatctga

SEQ ID NO: 2989 - RNA, 1449 nt, synthetic construct
  misc_feature 1..1449: note = derived and/or modified CDS sequence (wt) from CCHFV(China)__AF358784.1__N
  source 1..1449: mol_type = other RNA
atggagaacaaaatcgaggtgaataacaaagatgagatgaataagtggtttgaagagttcaagaaaggaaatggacttgtggacactttcacaaactcctactccttttgtgagagtgttccaaatctggacagatttgtatttcagatggccagtgccactgatgatgcacaaaaggattccatctacgcatcagctctggtggaagcaactaagttttgcgcacccatatacgagtgtgcctgggttagctccactggtattgtgaagagaggattggagtggttcgaaaaaaatgcaggaaccattaaatcttgggatgaaagctacactgaactgaaggttgaggttcccaaaatagaacagtttgccgattaccaacaggctgctctcaagtggaggaaggacataggtttccgtgtcaatgcaaatacgacagccttaagccacaaggtcctcgcagagtacaaagtccctggtgaaattgttatgtctgtcaaagaaatgttgtcagatatgattagaagaaggaacttgattctcaacagaggtggcgatgaaagtccacggggcccagtgagccgtgaacatgtggagtggtgcagggaatttgtcaaaggcaagtacatcatggctttcaacccgccttggggggacatcaacaagtcaggccggtcaggaatagcacttgttgcaacaggccttgctaagcttgcagagactgaggggaagggagtgtttgatgaagcaaaaaagactgtggaggctctcaacgggtacttgaacaaacataaggacgaggttgacaaagcaagtgccgacagcatgataacaaaccttcttaaacacattgccaaggcacaggagctttacaaaaactcgtctgcacttcgtgcacagggtgcacagattgatactgctttcagctcatactactggctctacaaggccggcgtgactccagaaaccttcccgactgtctcacagttcctttttgaactagggaagcaaccaaggggcaccaagaaaatgaagaaggcactcttgagcaccccattgaaatgggggaagaagctttatgagctctttgctgatgattccttccagcagaacaggatctacatgcaccctgctgtgctgacagctggcagaattagtgagatgggtgtctgctttgggacaatccctgtggccaaccctgatgatgctgcccagggatctggacacaccaagtccattcttaaccttcgtacaaacaccgagaccaacaatccgtgtgccaagacaattgtcaagttgtttgaaattcaaaaaacagggttcaacatacaagacatggacattgtggcttctgagcacctgctacaccaatcccttgtcggcaaacagtctccattccaaaatgcctacaatgtcaagggcaacgccaccagtgccaacatcatctga

SEQ ID NO: 2990 - RNA, 1449 nt, synthetic construct
  misc_feature 1..1449: note = derived and/or modified CDS sequence (wt) from CCHFV(China)__AF362080.1__N
  source 1..1449: mol_type = other RNA
atggagaataaaatcgaggtgaataacaaagatgaaatgaacaagtggtttgaagagttcaagaaaggaaatggacttgtggatactttcacaaactcctactccttttgtgagagtgttccaaatctggaaaggtttgtgtttcagatggccagtgccaccgatgatgcacaaaaggattccatctacgcatcagctctggtggaagcaaccaaattttgtgcacccatatacgagtgtgcctgggttagctccactggcattgtgaagaagggactggagtggttcgaaaaaaatgcaggaaccattaaatcttgggatgaaagctacactgagctgaaagttgaggtccctaaaatagaacagcttaccaattaccaacaggctgctctcaagtggaggaaggacataggttttcgtgtcaatgcaaatacggcagccttaagccacaaggtccttgcagagtacaaagtccctggcgaaattgtaatgtccgtcaaagaaatgttgtcagatatgattaggagaaggaacttgattctcaacagaggtggcgatgaaaatccacgaggcccagtgagccgtgaacatgtggagtggtgcagggaatttgtcaaaggcacgtacatcatggctttcaacccgccctggggggacatcaacaagtcaggccgatcaggaatagcacttgttgcaacaggccttgccaagctcgcagagactgaggggaagggagtgtttgatgaagccaaaaagactgtagaggctctcaacgggtaccttgacaaacacaaggacgaagttgacaaagcaagtgccgacaacatgataacaaaccttctcaaacacattgctaaggcacaagagctttacaaaaactcgtctgcacttcgtgcacagggtgcacagattgacactgctttcagctcatactactggctctacaaggccggcgtgactccagaaaccttcccgactgtctcacagttcctttttgagctagggaaacaaccaaggggtaccaagaaaatgaagaaggcactcttgagcaccccaatgaagtggggtaagaagctttatgagctctttgctgatgactcattccagcaaaacaggatctacatgcaccctgccgtgttgacagctggcagaatcagtgagatgggtgtctgctttggaacaatccctgtggccaatcccgatgatgctgcccagggatctggacacaccaagtccattcttaacctacggacaaacaccgaaaccaacaatccgtgtgccaagacaattgtcaagttgtttgaaattcaaaaaacaggatttaatatacaagacatggacattgtagcctctgagcacctgctgcaccaatcccttgtcggcaagcagtctccattccagaatgcctacaacgtcaagggcaatgccaccagtgccaacatcatctga

SEQ ID NO: 2991 - RNA, 1449 nt, synthetic construct
  misc_feature 1..1449: note = derived and/or modified CDS sequence (wt) from CCHFV(China)__AY029157.1__N
  source 1..1449: mol_type = other RNA
atggagaataaaatcgaggtgaataacaaagatgaaatgaacaagtggtttgaagagttcaagaaaggaaatggacttgtggatactttcacaaactcctactccttttgtgagagtgttccaaatctggaaaggtttgtgtttcagatggccagtgccaccgatgacgcacaaaaggattccatctacgcatcagctctggtggaagcaaccaaattttgtgcacccatatacgagtgtgcctgggttagctccactggcattgtgaagaagggactggagtggttcgaaaaaaatgcaggaaccattaaatcttgggatgaaagctacactgagctgaaagttgaggtccctaaaatagaacaacttgccaattaccaacaggctgctctcaagtggaggaaggacataggttttcgtgtcaatgcaaatacggcagccttaagccacaaggttcttgcagagtacaaagtccctggcgaaattgtaatgtccgtcaaagaaatgttgtcagatatgatcagaagaaggaacttgattctcaacagaggtggcgatgaaaatccacgaggcccagtgagccgtgaacatgtggagtggtgcagggaatttgtcaaaggcaagtacatcatggctttcaacccgccctggggggacatcaacaagtcaggccgatcaggaatagcacttgttgcaacaggccttgccaagctcgcagagactgaggggaagggagtgtttgatgaagccaaaaagactgtagaggctctcaacgggtaccttgacaaacacaaggatgaagttgacaaagcaagtgccgacaacatgataacaaaccttctcaaacacattgctaaggcacaagagctttacaaaaactcgtctgcacttcgtgcacagggtgcacagattgacactgctttcagctcatactactggctctacaaggccggcgtgactccagaaaccttcccgactgtctcacagttcctttttgagctagggaaacaaccaaggggtaccaagaaaatgaagaaggcacttttgagcaccccaatgaagtggggtaagaagctttatgagctctttgctgatgactcattccagcaaaacaggatctacatgcaccctgccgtgttgacagctggcagaatcagtgaaatgggtgtctgctttggaacaatccctgtggccaatcccgatgatgctgcccagggatctggacacaccaagtccattcttaacctacggacaaacaccgaaaccaacaatccgtgtgccaagacaattgtcaagttgtttgaaattcaaaaaacaggatttaatatacaagacatggacattgtagcctctgagcacctgctgcaccaatcccttgtcggcaagcagtctccattccagaatgcctacaacgtcaagggcaatgccaccagtgccaacatcatctga

SEQ ID NO: 2992 - RNA, 1449 nt, synthetic construct
  misc_feature 1..1449: note = derived and/or modified CDS sequence (wt) from CCHFV(DAK 8194)__U88411.1__N
  source 1..1449: mol_type = other RNA
atggagaacaaaatcgaagtgaacaacaaagatgagctgaacaaatggtttgaggagttcaagaaaggaaacgggcttgtggacactttcacaaactcctattctttctgtgagaacatgccgaaccttgacaggtttgtattccagatggctggtgcaaccgatgatgcacagaaagattccatctatgcatctgccctggttgaggctaccaagtactgtgctcccatatatgaatgtgcctgggttagctccacaggtatagtgaaaagaggccttgagtggtttgaaaaaaatacaggaaccattaagtcttgggatgagagctacactgagctgaaagtggatgtgcccaaaattgaacagcttgccaactaccagcaggccgctctcaagtggaggaaggacataggcttccgcgttaatgcaaacacagcggccctaagcaacaaagtcctctctgagtacaaggttcctggtgagattgtgatgtctgtcaaagagatgctttcagacatgattagaaggaggaacctgatccttaacagaggaggtgatgagaacccaagaggcccagtaagcaaggagcacatagaatggtgcagggagtttgtcaagggcaaatatataatggccttcaatccaccctggggtgatgtcaacaagtccggccgctcaggaatagcactagttgctacaggtcttgccaaacttgcagaaacagaaggaaagggagtttttgaggaggcaaagaagacagtggaggccctcaaggagtaccttgacaaacacaaagatgaggtggacaaggctagtgctgacagcatggtaacaaacctcctcaagcacatcactaaggcccaggaactctacaaaaactcatcagcactgagagcacagggtgcacagattgacacccctttcagctccttctactggctctataaagcgggcgtgactccagaaaccttccccaccgtctctcaattcctctttgagctgggaaagcagccaagaggcactaaaaaaatgaagaaggcacttctgagcaccccaatgaaatggggaaagaagctttatgagctctttgctgatgactctttccagcaaaacaggatctacatgcaccctgctgtgctgacagctggcagaattagtgagatgggtgtttgctttggaaccatccctgttgccgatccagacgatgcagcccagggctcaggtcacaccaaatcaattctgaacctccgaacaagtagtgaaactaacaatccttgtgctaaaacgattgtcaaactcttcgaagttcaaaaaacaggattcaacatacaggacatggatattgttgcctctgagcacctgctgcaccagtctcttgttggcaagcaatccccgttccaaaatgcttacaacgtcaaaggcaatgccaccagtgccaacattatctaa

SEQ ID NO: 2993 - RNA, 1449 nt, synthetic construct
  misc_feature 1..1449: note = derived and/or modified CDS sequence (wt) from CCHFV(Drosdov)__U88412.1__N
  source 1..1449: mol_type = other RNA
atggaaaacaagatcgaggtgaacagcaaagatgagatgaataaatggtttgaggagtttaaaaaggaaaatggacttatggacactttcacaaactcctactccttttgtgagaatgtaccaaatctggataagtttgtgttccagatggccagcgccactgatgatgctcagaaggactccatctatgcatcggctctggtggaagcaaccaagttctgtgcacccatatatgaatgtgcttgggtcagctctaccggcattgtgaagaaggggcttgagtggttcgaaaagaattcaggaaccatcaaatcctgggatgagaactatactgagctgaaggttgatgttcccaaaatagagcaacttgccaattaccaacaggctgctctcaaatggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatctaattctcaacaggggcggtgatgaaaatccgcgcggcccagtgagccgtgaacatgtggagtggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagccaagaagaccgtggaggctctcaatgggtatttggacaagcacagagacgaagttgacaaagcaagtgctgacagcatgataacaaacctcctgaagcacattgccaaagcacaagagctttataaaaattcatctgctcttcgtgcacaaggtgcacagattgacacccctttcagctcgttttactggctttacaaggccggtgtgactccagagaccttcccaactatctcacagttcctttttgaactggggaagcaaccaagggggaccaagaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgacgctgctcagggatctggacataccaagtccattctcaaccttcggacaagcacagaaaccaacaatccttgcgccaagacaattgtcaaattgtttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 2994 - RNA, 1449 nt, synthetic construct
  misc_feature 1..1449: note = derived and/or modified CDS sequence (wt) from CCHFV(Eskisehir23-2012)__KR092376.1__N
  source 1..1449: mol_type = other RNA
atggaaaacaagatcgaggtgaacagcaaagacgagatgaacaaatggtttgaggagtttaaaaagggaaatggacttatggacactttcacaaactcctactccttttgtgagaatgtaccaaatctggataagtttgtgttccagatggccagcgccactgatgatgcacagaaggactccatctatgcatcggctctggtggaggcaaccaagttttgtgcacccatatatgaatgtgcttgggtcagctctaccggcattgtgaagaaggggcttgagtggttcgagaagaatacaggaactattaaatcctgggatgagaactatgctgagctgaaggttgatgttcctaaaatagaacaacttgccaattaccaacaggctgctctcaagtggaggaaagacataggtttccgtgtcaatgcaaacacggcagccttaagcaacaaagtccttgcagaatataaagtccctggcgaaattgtgatgtctgttaaagaaatgctgtcggacatgattagaaggaggaatctaattctcaacaggggcggtggtgaaaatccacgcggcccagtgagccgtgaacatgtggagtggtgcagggaatttgtcaaaggcaagtatatcatggccttcaatccaccttggggggacatcaacaaatcaggccgttcaggaatagcacttgttgcaacaggccttgccaagcttgcagagaccgaggggaaaggagtttttgacgaagctaagaggaccgtggaggctctcaatgggtatttggacaagcacagggacgaagttgacaaagcaagtgctgacagcatgataacaaaccttctgaagcacattgccaaagcacaagagctttataagaattcatctgctcttcgtgcacaaggtgcacagattgacactcctttcagctcgttttactggctctacaaggccggagtgactccagagaccttcccaactatctcacaattccttttcgaactagggaagcaaccaaggggaaccaagaaaatgaaaaaggcactcctgagcactccaatgaagtgggggaagaaactttatgagctctttgccgatgactctttccagcagaacagaatctacatgcaccctgctgtgttgacagctggtagaatcagtgaaatgggtgtctgctttggaacaatccctgttgccaaccctgatgatgctgctcaaggatctggacataccaagtccatcctcaaccttcggacaagcacagagaccaacaacccatgtgccaagacaattgtcaaattatttgaaatccaaaaaacaggatttaacatacaggacatggacattgtagcctctgagcacctgctgcaccaatcccttgttggcaagcagtctccattccaaaatgcctacaacgtcaagggcaatgccaccagtgccaacatcatctaa

SEQ ID NO: 2995 - RNA, 1449 nt, synthetic construct
  misc_feature 1..1449: note = derived and/or modified CDS sequence (wt) from CCHFV(Hodzha)__AY223475.1__N
  source 1..1449: mol_type = other RNA
atggagaataaaatcgaggtgaacaacaaagatgagatgaacaagtggtttgaagagttcaaaaaaggaaatggacttgtggacactttcacaaactcctactccttttgtgagagtgttccaaatctggacagatttgtatttcagatggccagtgctactgatgatgcacaaaaggattccatctacgcatctgctctagtggaggcaaccaaattttgcgcacccatatacgagtgtgcctgggttagctccactggcattgtgaagaagggactggagtggttcgagaaaaatgcgggaaccattaagtcttgggatgaaagctacactgagctgaaagttgaggtccctaaaatagagcagcttgccaattaccaacaggctgctctaaagtggagaaaggacataggtttccgtgttaatgcaaatacggcggccttaagccataaggtcctttcagaatacaaagtccctggtgaaattgtaatgtctgtcaaagaaatgttgtcagatatgattagaaggaggaacttaattctcaacagaggtggcgatgaaaatccacgaggcccggtgagccgtgaacatgtggagtggtgcagggagtttgtcaaaggcaagtacatcatggctttcaacccaccttggggcgatatcaacaagtcaggtcggtcaggaatagcacttgttgcaacaggccttgccaaacttgcagagactgaagggaaaggagtgtttgatgaagcgaaaaagactgtggaggctctcaacgggtacctggacaagcataaggacgaggttgacaaagcaagtgccgacaacatgacaacaaaccttcttaaacacatcgccaaggcacaggagctttacaaaaactcgtctgcacttcgtgcacagggtgcacagattgacactgctttcagctcatactactggctctataaggccggcgtgaccccagaaaccttcccaactgtctcacagtttcttttcgaattagggaagcaaccaaggggtaccaagaaaatgaagaaggcactcttgagcactccaatgaagtgggggaagaagctctatgagctctttgctgatgattctttccagcagaacaggatctacatgcaccctgctgtgttgacagccggcagaatcagtgagatgggtgtctgctttggaacagtccctgtggccgatcctgatgatgccgcccagggatccggacacaccaagtccattcttaatcttcgaacaaacaccgagaccaacaatccgtgtgccaagacaattgtcaagttgtttgaaattcaaaaaacagggtttaacatacaggacatggacattgtagcctctgagcacctgctgcaccagtctcttgtcggcaagcagtctccgttccaaaatgcctacaatgtcaagggcaacgctacaagtgccaacatcatctga

SEQ ID NO: 2996 - RNA, 1449 nt, synthetic construct
  misc_feature 1..1449: note = derived and/or modified CDS sequence (wt) from CCHFV(Iran-52)__DQ446212.1__N
  source 1..1449: mol_type = other RNA
atggaaaacaaaatcgaagtgaacagcaaagatgagatgaacaagtggtttgaggagttcaagaaaggaaatggacttgtggacaccttcacaaactcctattccttttgtgaaagcgttccaaatctggacagatttgtattccagatggctagtgccactgatgatgcacaaaaggattccatctacgcatctgctctggtggaggcaaccaaattttgtgcacctatatacgaatgtgcctgggctagctccactggcattgttaagaagggactggagtggttcgaaaaaaatgcaggaaccattaaatcatgggatgaaagttacactgagctgaaagttgaggttcccaaaatagaacagctttccaactaccagcaggctgctctcaagtggaggaaagacataggcttccgtgtcaatgcaaacacagcagctttgagcaacaaggtccttgcagagtacaaggttcctggcgaaattgtaatgtctgtcaaagagatgttgtcagatatgattaggagaaggaacctgattctcaacagaggtggtgatgaaaacccacgcggcccagtcagccgtgaacatgtggaatggtgtagggaatttgtcaaaggcaagtacataatggctttcaacccaccttggggggacatcaacaagtcaggccgttcaggaatagcacttgttgcaacaggccttgccaagcttgcagagactgaagggaagggagtttttgacgaagccaagaaaactgtagaggctctcaacgggtatctggacaagcataaggacgaggttgacaaagcaagtgctgacagcatgataacaaaccttctcaagcatattgctaaagcacaggagctttacaaaaactcgtctgctctccgtgcacagggtgcacagattgataccgtctttagctcgtactactggctctacaaggccggcgtgactccagatactttcccgactgtctcacagttcctttttgagttagggaagcagccaaggggtaccaagaaaatgaagaaggcactcttgagcaccccaatgaagtgggggaagaagctttatgagcttttcgccgatgattctttccagcagaacaggatctacatgcaccctgctgtgctgacagctggcagaatcagtgaaatgggtgtctgctttggaacaatccctgtggccaatcctgatgatgctgccttaggatctgggcacaccaagtccattctcaaccttcggacaaacactgagaccaacaatccatgtgccaggacaattgttaagttgtttgaaattcaaaaaacagggttcaacatacaggacatggacattgtggcctctgagcacctactgcaccaatcccttgttggcaagcagtctccatttcaaaatgcctacaacgtcaaggggaacgccaccagtgccaatatcatctaa

SEQ ID NO: 2997 - RNA, 1449 nt, synthetic construct
  misc_feature 1..1449: note = derived and/or modified CDS sequence (wt) from CCHFV(Iran-53)__DQ446213.1__N
  source 1..1449: mol_type = other RNA
atggaaaacaaaatcgaggtgaacagcaaagatgagatgaacaagtggtttgaggagttcaagaaaggaaatggacttgtggacaccttcacaaactcctattccttttgtgaaagcgttccaaatctggacagatttgtattccagatggctagtgccactgatgatgcacaaaaggattccatctacgcatctgctctggtggaggcaaccaaattttgtgcacctatatacgaatgtgcctgggctagctccactggcattgttaagaagggactggagtggttcgaaaaaaatgcaggaaccattaaatcatgggatgaaagttatactgagctgaaagttgaggttcccaaaatagaacagctttccaactaccagcaggctgctctcaagtggaggaaagacataggcttccgtgtcaatgcaaacacagcagctttgagcaacaaggtccttgcagagtacaaggttcctggcgaaattgtaatgtctgtcaaagagatgttgtcagatatgattaggagaaggaacctgattctcaacaaaggtggtgatgaaaacccacgcggcccagtcagccgtgaacatgtggaatggtgtagggaatttgtcaaaggcaagtacataatggctttcaacccaccttggggggacatcaacaagtcaggccgttcaggaatagcacttgttgcaactggccttgccaagcttgcagagactgaagggaagggagtttttgacgaagccaagaaaactgtagaggctctcaacgggtatctggacaagcataaggacgaggttgacaaagcaagtgctgacagcatgataacaaaccttctcaagcatattgctaaagcacaggagctttacaaaaactcgtctgctctccgtgcacagggtgcacagattgataccgtctttagctcgtactactggctctacaaggccggcgtgactccagatactttcccgactgtctcacagttcctttttgagttagggaagcagccaaggggtaccaagaaaatgaagaaggcactcttgagcaccccaatgaagtgggggaagaagctttatgagcttttcgccgatgattctttccagcagaacaggatctacatgcaccctgctgtgctgacagctggcagaatcagtgaaatgggtgtctgctttggaacaatccctgtggccaatcctgatgatgctgccttaggatctgggcacaccaagtccattctcaaccttcggacaaacactgagaccaacaatccatgtgccaggacaattgttaagttgtttgaaattcaaaaaacagggttcaacatacaggacatggacattgtggcctctgagcacctactgcaccaatcccttgttggcaagcagtctccatttcaaaatgcctacaacgtcaaggggaacgccaccagtgccaatatcatctaa

SEQ ID NO: 2998 - RNA, 1449 nt, synthetic construct
  misc_feature 1..1449: note = derived and/or modified CDS sequence (wt) from CCHFV(JD 206)__U88414.1__N
  source 1..1449: mol_type = other RNA
atggaaaacaaaatcgaggtgaacagcaaagatgagatgaacaagtggtttgaggagttcaagaaaggaaatggacttgtggacaccttcacaaactcctattccttttgtgaaaacgttccaaatctggacagatttgtattccagatggctagtgccactgatgatgcacaaaaggattccatctacgcatctgctctggtggaggcaaccaaattttgtgcacctatatacgaatgtgcctgggctagctccactggcattgttaagaagggactggagtggttcgaaaaaaatgcaggaaccattaaatcatgggatgaaagttatactgagctgaaagttgaggttcccaaaatagaacagctttccaactaccagcaggctgctctcaagtggaggaaagacataggcttccgtgtcaatgcaaacacagcagctttgagcaacaaggtccttgcagagtacaaggttcctggcgaaattgtaatgtctgtcaaagagatgttgtcagatatgattaggagaaggaacctgattctcaacagaggtggtgatgaaaacccacgcggcccagtcagccgtgaacatgtggagtggtgtagggaatttgtcaaaggcatgtacataatggctttcaacccaccttggggggacatcaacaagtcaggccgttcaggaatagcacttgttgcaacaggccttgccaagcttgcagagaccgaagggaagggagtttttgacgaagccaagaaaactgtagaggctctcaacgggtatctggacaagcataaggacgaggttgacaaagcaagtgctgacagcatgataacaaaccttctcaagcatattgctaaagcacaggagctttacaaaaactcgtctgctctccgtgcacagggtgcacagattgataccgtcttcagctcgtactactggctctacaaggccggtgtgactccagatactttcccaactgtctcacagttcctttttgagttagggaagcagccaaggggtaccaaaaaaatgaagaaggcactcttgagcaccccaatgaagtgggggaagaagctttatgagcttttcgccgatgattccttccagcagaacaggatctacatgcaccctgctgtgctgacagctggcagaatcagtgaaatgggtgtctgctttggaacaatccctgtggccaatcctgatgatgctgccttaggatctgggcacaccaagtccattctcaaccttcggacaaacactgagaccaacaatccatgtgccaagacaattgttaagttgtttgaaattcagaaaacagggttcaacatacaggacatggacattgtggcctctgagcacctgctgcaccaatcccttgttggcaagcagtctccatttcaaaatgcctacaacgtcaaggggaacgccaccagtgccaacatcatctaa

SEQ ID NO: 2999 - RNA, 1449 nt, synthetic construct
  misc_feature 1..1449: note = derived and/or modified CDS sequence (wt) from CCHFV(Kashmanov)__DQ211644.1__N
  source 1..1449: mol_type = other RNA
atggaaaacaagatcgaggtgaacagcaaagatgagatgaacaaatggtttgaggagtttaaaaaggaaaatggacttatggacactttcacaaactcctactccttttgtgagaatgtaccaaatctggataagtttgtgttccagatggccagcgccactgatgatgcacagaaggactccatctatgcatcggctctggtggaagcaaccaagttctgtgcacccatatatgaatgtgcctgggtcagctctaccggcattgtgaagaaggggcttgagtggttcgagaagaattcaggaaccatcaaatcctgggatgagaactatgctgagctgaaggttgatgttcccaaaatagaacaacttgccaattaccagcaggctgctctcaagtggaggaaggacataggtttccgtgtcaatgcaaacacggcagccttaagcaacaaggtccttgcagaatataaagtccctggcgaaattgtgatgtctgttaaagaaatgctgtcagacatgattagaaggaggaatctaattctcaacaggggcggtgatgaaaatccgcgcggcccagtgagccgtgaacatgtggagtggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagccaagaagaccgtggaggctctcaatgggtatttggacaagcacagggacgaagttgacaaagcaagtgctgacagcatgataacaaacctcctgaagcacattgccaaagcacaagagctttataaaaattcatctgctcttcgtgcacaaggtgcacagattgacacccctttcagctcgttttactggctttacaaggccggtgtgactccagagaccttcccaactatctcacagttccttttcgaactggggaagcaaccaagggggaccaagaaaatgaaaaaggcactcctgagcactccaatgaagtgggggaagaaactttatgagctctttgctgatgactctttccagcagaacagaatctacatgcaccctgctgtgttaacagccggtagaatcagtgaaatgggtgtctgctttggaacaatccctgttgccaatcctgatgacgctgctcagggatctggacataccaagtccattctcaaccttcggacaagcacagagaccaacaatccatgcgccaagacaattgtcaaattgtttgaaatccaaaaaacaggatttaacatacaggacatggacattgtagcctctgagcacctgctgcaccaatcccttgttggcaagcagtctccattccaaaatgcctataacgtcaagggcaatgccaccagtgccaacatcatctaa

SEQ ID NO: 3000 - RNA, 1449 nt, synthetic construct
  misc_feature 1..1449: note = derived and/or modified CDS sequence (wt) from CCHFV(NIV 10405051)__JF922681.1__N
  source 1..1449: mol_type = other RNA
atggagaataaaatcgaggtgaacaacaaagatgagatgaacaagtggtttgaagagttcaagaaaggaaatggacttgtggacactttcacaaactcctactccttttgtgagagtgttccaaatctggacagatttgtatttcagatggccagtgctactgatgatgcacaaaaggattctatctacgcatctgctctagtggaggcaaccaaattttgcgcacccatatacgagtgtgcttgggttagctccactggtattgtgaagaagggactggagtggttcgagaaaaatgcaggaaccattaaatcttgggatgaaagctacactgagctgaaagttgaggtccctaaaatagagcagcttgccaattaccaacaggctgctctaaagtggagaaaggacataggtttccgtgttaatgcaaatacggcagccttgagtcataaggtccttgcagaatataaagtccctggtgaaattgtaatgtctgtcaaagaaatgttgtcagatatgattagaaggaggaacttaattctcaacagaggtggcgatgaaaatccacgaggcccggtgagccgtgaacatgtggaatggtgcagggagtttgtcaaaggtaagtacatcatggctttcaacccaccttggggtgatatcaacaagtcaggtcggtcaggaatagcacttgttgcaacaggccttgccaagcttgcagagactgaagggaaaggagtgtttgatgaagcaaaaaagactgtggaggctctcaacgggtacctagacaagcataaggacgaggttgacaaagcaagtgccgacaacatgataacaaaccttcttaaacacatcgccaaggcacaggagctttacaaaaactcgtctgcacttcgtgcacagggtgcacagattgacactgctttcagctcatactactggctctacaaggccggcgtgactccagaaaccttcccaactgtctcacagttccttttcgaactagggaagcaaccaaggggtaccaagaaaatgaagaaagcactcttgagcactccaatgaggtgggggaagaagctctatgagctctttgctgatgattctttccagcagaacaggatctacatgcatcccgctgtgttgacagccggcagaatcagtgagatgggtgtctgctttggaacaatccctgtggccaatcctgatgatgctgcccagggatccggacacaccaagtccattcttaatcttcgaacaaacaccgagaccaacaatccgtgtgccaagacaattgtcaagttgtttgaaattcaaaaaacagggtttaacatacaggacatagacattgtagcctctgagcacctgctgcaccagtctcttgtcggcaagcagtctccattccaaaatgcctacaatgtcaagggcaacgctacaagtgccaacatcatctaa

SEQ ID NO: 3001 - RNA, 1449 nt, synthetic construct
  misc_feature 1..1449: note = derived and/or modified CDS sequence (wt) from CCHFV(Oman)__DQ211645.1__N
  source 1..1449: mol_type = other RNA
atggaaaacaaaatcgaggtgaataataaagatgagatgaacaagtggttcgaggagttcaagaaaggaaatggacttgtggacaccttcacaaactcctattccttttgtgagagtgtcccaaatctggacagatttgtattccagatggctagtgccactgatgatgcacaaaaggattccatctacgcatctgctctagtggaggcaaccaaattctgtgcacctatatacgagtgtgcttgggctagctccactggcattgttaagaaggggctggagtggttcgaaaaaaatgcaggaaccattaaatcttgggatgagagttacactgagctgaaagttgaagttcccaaaatagaacaactttccaactaccaacaggctgctctcaagtggaggaaagacataggcttccgtgtcaatgcaaacacggcagctttaagtaacaaggtccttgcagaatacaaagttcctggcgaaattgtgatgtctgtcaaagagatgttgtcagatatgattagaaggaggaacctgattctcaacagaggtggtgatgaaaacccacgcggcccagtcagccgtgagcatgtggagtggtgtagggaatttatcaaaggcaagtacataatggcttttaacccaccttggggggacatcaacaagtcaggccgttcaggaatagcactcgttgcaacaggccttgccaagcttgcagagactgaagggaagggagttttcgacgaagccaagaagactgttgaggctctcaacgggtatctggacaagcacaaggacgaagttgacaaagcaagtgctgacagcatgataacaaaccttcttaagcatattgctaaagcacaggagctttacaaaaactcgtctgctctccgtgcacagggtgcacagattgacaccgtcttcagctcatactactggctctacaaggccggtgtgactccagacaccttcccgactgtctcacagtttctttttgagttaggaaagcaaccaaggggcaccaagaaaatgaagaaggcactcttgagcaccccaatgaagtggggaaagaagctttatgagctttttgccgatgattccttccagcagaacaggatctacatgcaccccgctgtgctgacagccggcagaatcagtgaaatgggagtctgctttggaacaatccctgtggccaatcctgatgatgctgctttaggatctggacacaccaagtccattctcaaccttcggacaaacactgagaccaacaatccgtgtgccaagacaattgttaagttgtttgagattcagaaaacaggattcaacatacaggacatggatattgtagcctctgagcacctgctgcaccagtctcttgttggtaagcagtctccatttcaaaatgcctacaacgtcaaggggaacgccaccagtgccaacatcatctaa

SEQ ID NO: 3002 - RNA, 1449 nt, synthetic construct
  misc_feature 1..1449: note = derived and/or modified CDS sequence (wt) from CCHFV(SCT ex Afghanistan)__JX908640.1__N
  source 1..1449: mol_type = other RNA
atggaaaacaaaatcgaggtgaacaacaaagatgagatgaacaaatggtttgaggagttcaagaaaggaaatggacttgtggacactttcacaaactcatattccttttgtgaaagtgttccaaatctggacagatttgtgttccagatggctagtgccactgatgatgcacaaaaggactccatctacgcatctgctctagtggaggcaaccaagttttgtgcacctatatacgagtgtgcttgggctagctccactggcattgttaagaagggactggagtggtttgagaaaaatgcaggaaccattaaatcttgggatgagagttatactgagctgaaagttgaagttcccaaaatagaacaactttccaactaccagcaggctgctctcaagtggaggaaagacataggtttccgtgtcaatgcaaacacggcagctttgagtaacaaagtcctagcagaatacaaagttcctggcgaaattgtaatgtctgtcaaagagatgttgtcagatatgattagaagaaggaacctgattctcaacagaggtggtgatgaaaacccacgtggcccagttagccgtgaacatgtggagtggtgtagggaattcattaaaggcaaatacataatggccttcaacccaccttggggggacatcaacaagtcaggccgttcaggaatagcacttgttgcaacaggccttgccaagcttgcagaaactgaggggaagggggtttttgatgaagccaagaagactgtagaggctctcaacgggtacttagacaagcataaggacgaagttgacaaagcaagtgctgacagcatgataacaaacctccttaagcatattgctaaggcacaagagctttacaaaaactcgtctgctcttcgtgctcagggtgcacagattgacaccgtcttcagctcttactactggctctacaaggccggtgtgactccagagaccttcccgactgtctcacagttcctttttgagttagggaaacaaccaaggggtaccaagaaaatgaagaaggcactcttgagcaccccaatgaagtgggggaagaagctttatgagctttttgccgatgattctttccagcagaacaggatctacatgcaccccgctgtgctgacagccggcagaatcagtgaaatgggtgtctgctttggaacaatccctgtggccaatcctgatgatgctgctttaggatctggacacactaagtccattctcaaccttcggacaaacactgaaaccaataatccgtgtgccaagacaattgttaagttgtttgaaattcagaaaacagggtttaacatacaggacatggatattgtggcctccgagcacctgctgcaccaatctcttgttggcaagcagtctccatttcaaaatgcctacaacgtcaaggggaatgccaccagtgccaacatcatctaa

SEQ ID NO: 3003 - RNA, 1449 nt, synthetic construct
  misc_feature 1..1449: note = derived and/or modified CDS sequence (wt) from CCHFV(Semunya)__DQ076413.1__N
  source 1..1449: mol_type = other RNA
atggagaataaaatcgaagtgactagcaaggatgaaatgaacaggtggtttgaggagttcaagaagagtaatggacttgtggacacctttacaaattcttactccttttgtgagagtgtccccaatcttgacaggtttgtattccagatggccagtgctacagacgatgcacaaaaggactccatctatgcttctgctctagtggaggcaaccaagttttgtgcacctatatacgagtgtgcatgggtcagctctaccggcatagtcaaaaaaggccttgagtggttcgaaaaaaatgcaggaactatcaagtcttgggatgagagctacactgaacttaaggttggtgtccccaagatagagcagcttgcaaactaccagcaggctgctctgaagtggaggaaggatattggtttccgtgtcaatgctaatacggcagccttgagcaacaaagtccttgcagaatataaagtccctggtgagattgtgatgtctgtcaaagaaatgttgtcagacatgatcagaagaaggaacttgattcttaacagaggtggtgatgagaacccacgcggcccggtgagccgtgagcatgtggaatggtgcagggaatttgtcaagggcaagtacatcatggctttcaacccaccctggggagacattaacaagtcaggccgctcagggatagcgcttgtcgcaacgggtcttgccaagcttgcagaaactgaagggaaaggagtgtttgatgaagccaaaaaaactgtagaggcccttaatggctatttggataagcataaggatgaggtagacaaggctagtgctgacggcatggtgacaaacctcctcaagcacattgcaaaagcacaagagctctacaaaaattcatctgcacttcgtgcacaaggtgcacagattgatactccttttagctcattttactggctttacaaggctggcgtatctccagaaaccttcccaactgtttcacagtttcttttcgagctagggaagcaaccaaggggcaccaagaaaatgaagaaggcactcctgagcactccaatgaagtggggaaagaaactctatgaactctttgctgatgattctttccaggagaacagaatctatatgcaccccgctgtgttaacagccggcagaatcagtgagatgggtgtctgcttcggaaccatccctgtagctaaccctgatgacgctgcccaaggatcagggcacaccaagtccattctcaacctaaggacaaacacagagactaacaatccatgtgctaagacaattgttaaactgtttgaaatccaaaagacaggattcaacatacaggacatggacattgtggcctctgaacatctgctgcatcagtctcttgttggaaagcagtctcctttccagaatgcctacaacgtcaaaggcaacgccaccagtgctaacattatctga

SEQ ID NO: 3004 - RNA, 1449 nt, synthetic construct
  misc_feature 1..1449: note = derived and/or modified CDS sequence (wt) from CCHFV(SK 2015/human)__KX129738.1__N
  source 1..1449: mol_type = other RNA
atggaaaacaaaatcgaggtgaacaataaagatgagatgaacaagtggtttgaggagttcaagaaaggaaatggacttgtagacacctacacaaactcctattccttttgcgaaagcgttccaaatctggacagatttgtattccagatggctagtgccactgatgatgcacaaaaagactccatctacgcatctgctctggtggaggcaaccaaattttgtgcacctatatacgagtgtgcttgggctagctccactggcattgttaagaagggactggagtggttcgagaagaatgcagggaccattaaattgtgggatgagagttatgccgagctgaaagttgaagttcccaaaatagaacaactttccaactaccagcaggctgctctcaagtggagaaaagacataggcttccgtgtcaatgcaaacacggcagctctgagcaacaaggtccttgcagaatacaaagttcctggcgagattgtgatgtctgtcaaagagatgttgtcagatatgattagaagaaggaacctgatcctcaacagaggtggtgatgaaaacccacgcggcccagtcagccgtgaacatgtggagtggtgtagggagtttgtcaaaggcaagtacataatggctttcaacccaccttggggggacataaataagtcaggccgttcaggaatagcacttgttgcaacgggccttgccaagcttgcagagaccgaagggaagggagtttttgacgaagccaagaagactgtagaggctctcaacgggtatctggacaagcacaaggacgaggttgataaagcaagtgctgacagcatgataacaaaccttcttaagcatattgctaaagcacaggagctttacaaaaactcgtctgctctccgtgcacagggtgcacagattgataccgtcttcagctcatattactggctctacaaggccggtgtgactccagacactttcccaactgtctcacagttcctttttgagttagggaagcaaccaaggggtaccaagaaaatgaagaaggcactcttgagcaccccaatgaagtggggaaagaagctttatgagctttttgcagacgattccttccagcaaaacaggatctacatgcaccccgctgtgctgacagccggcagaatcagtgaaatgggtgtctgctttggaacagtccctgtggctaatcccgatgatgctgccttaggatctggacacaccaagtccattctcaaccttcggacaaacaccgagaccaacaatccatgtgccaagacaattgttaagttgttcgaaatccagaaaacaggattcaatatacaggacatggacattgtggcctctgagcacctgttgcatcaatcccttgttggcaagcagtctccatttcaaaatgcctacaacgtcaaggggaacgccaccagtgccaacatcatctaa

SEQ ID NO: 3005 - RNA, 1449 nt, synthetic construct
  misc_feature 1..1449: note = derived and/or modified CDS sequence (wt) from CCHFV(SPU128/81/7)__DQ076415.1__N
  source 1..1449: mol_type = other RNA
atggaaaacaaaattgaggtgaataacaaacatgagatgaacaagtggtttgaagagttcaaaaaaggaaatggacttgtggacaccttcacaaactcctattccttttgtgagagtgttccaaatttggacaagtttgtgttccaaatggccagtgccaccgatgatgcacaaaaggattccatctacgcgtctgctctagtggaggcaacaaaattttgtgcacctatatatgagtgtgcatgggttagctccactggcattgtgaagaggggacttgaatggttcgaaaaaaatgcgggcaccattaagtcttgggatgaaagttatactgagctaaaagttgacgtcccgaaaatagaacagcttgccaattaccaacaggctgccttgaagtggaggaaagacataggtttccgtgtcaatgcaaacacagcggctctgagcaacaaagtccttgcagagtacaaagttccgggagagattgtgatgtctgtcaaagagatgctgtcagacatgattaggagaaggaaccagattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgtcgctacaggccttgccaagcttgcagagactgaaggaaagggagtatttgacgaagccaaaaagactgtggaggtcctcaatgggtatctggacaagcacaaggacgaagttgacagagcgagtgctgacagcatgataacaaaccttctcaagcacattgccaaggcacaggagctttataagaattcgtctgcactccgtgcacaaggtgcacagattgacactgctttcagctcatactattggctttacaaggctggcgtgaccccagagacattcccgacggtgtcacagttcctctttgagctaggaaaacagccaagaggtaccaagaaaatgaagaaggctctgctgagcaccccaatgaagtgggggaagaaactttatgaactctttgccgacgattctttccagcagaacaggatctacatgcaccctgccgtgctcacagctggcagaatcagtgaaatgggagtctgctttgggacaatccccgtggccaaccctgatgatgctgctcaaggatctggacataccaagtctattctcaacctccggactaacaccgagaccaacaatccgtgtgccaggaccattgtcaagctgtttgaaattcagaaaacagggttcaacattcaggacatggacatagtggcctctgagcacttgctgcaccagtctcttgttggcaaacaatctccattccagaacgcctacaacgtcaagggcaatgccaccagtgctaacattatctaa

SEQ ID NO: 3006 - RNA, 1449 nt, synthetic construct
  misc_feature 1..1449: note = derived and/or modified CDS sequence (wt) from CCHFV(Sudan Al-Fulah 4-2008)__GQ862372.1__N
  source 1..1449: mol_type = other RNA
atggaaaacaaaatcgaggtgaataacaaggatgaaatgaacaagtggtttgaagagttcaaaaagggaaatggacttgtggacaccttcacaaactcctattccttttgtgagagtgttccaaacttggacaagtttgtgttccaaatggccagtgccactgatgatgcacaaaaggattccatatatgcatctgctctggtggaggcaacaaaattttgtgcacctatatatgagtgtgcatgggttagctccactggcattgtgaagaggggacttgaatggttcgaaaaaaatgcgggcaccatcaagtcttgggatgaaagttatactgagctaaaagttgacgtcccgaaaatagaacaacttgctaattaccaacaggctgccttgaaatggaggaaagacataggtttccgtgtcaatgcaaacacagcggctctgagcaacaaagtcctcgcagagtacaaagttcctggcgagattgtgatgtctgtcaaagagatgctgtcagacatgattaggagaaggaaccagattctaaacaggggtggtgatgagaatccacgtggccctgtgagccgtgagcatgtggactggtgcagggagtttgtcaaaggcaaatacatcatggccttcaacccaccatggggggacatcaacaagtcaggccgttcaggaatagcacttgttgcaacaggccttgccaagcttgcagagactgaaggaaagggagtttttgacgaagccaaaaagactgtggaggccctgaatgggtatctggacaagcacaaggacgaagttgacagagcgagtgctgacagcatgataacaaaccttctcaagcacattgccaaggcacaggagctttataagaactcgtctgctctccgtgcacaaggtgcacagatagacactgctttcagctcatactattggctttacaaggctggcgtgaccccagagaccttcccgacggtgtcgcagttcctctttgagctaggaaaacagccaagaggtaccaagaaaatgaagaaggctctgctgagcaccccaatgaagtgggggaagaaactttatgaactctttgccgacgattctttccagcagaacagaatctacatgcaccctgccgtgcttacagcaggcagaatcagtgaaatgggagtctgctttgggacaatccccgtggccaaccctgatgatgctgcccaaggatctggacataccaagtccattctcaacctacggactaacaccgaaaccaacaatccgtgtgctaggaccattgtcaagttgtttgaaattcagaaaacagggttcagcattcaggacatggacatagtggcctctgagcacttgctgcaccagtctcttgttggcaagcaatctccattccagaacgcctacaatgtcaagggcaatgccactagtgctaacatcatctaa

SEQ ID NO: 3007 - RNA, 1449 nt, synthetic construct
  misc_feature 1..1449: note = derived and/or modified CDS sequence (wt) from CCHFV(TAJUK)__JN086996.1__N
  source 1..1449: mol_type = other RNA
atggagaataaaatcgaggtgaacaacaaagatgagatgaacaagtggtttgaagagttcaagaaaggaaatggacttgtggacactttcacaaactcctactccttttgtgagagtgttccaaatctggacagatttgtatttcagatggccagtgctactgatgaagcacaaaaggattccatctacgcatctgctctagtggaggcaaccaaattttgcgcacccatatacgagtgtgcttgggttagctccactggtattgtgaagaaaggattggagtggttcgagaaaaatgcaggaaccattaaatcttgggatgaaagctacactgagctgaaagttgaggtccctaaaatagagcagcttgccaattaccaacaggctgctctaaagtggagaaaggacataggtttccgtgttaatgcaaatacggcagccttgagccataaggtccttgcagaatacaaagtccctggtgaaattgtaatgtctgtcaaagaaatgttgtcagatatgattagaaggaggaacttgattctcaacagaggtggcgatgaaaatccacgaggcccggtgagccgtgaacatgtggaatggtgcagggagtttgtcaaaggcaagtacatcatggctttcaacccaccttggggcgatatcaacaagtcaggtcggtcaggaatagcacttgttgcaacaggccttgccaagcttgcagagactgaaggaaaaggagtgtttgatgaagcaaaaaagactgtggaggctctcaacgggtacctagacaagcataaggacgaggttgacaaagcaagtgccgacaacatgataacaaaccttcttaaacacatcgccaaggcacaggagctttacaaaaactcgtctgcacttcgtgcacagggtgcacagattgacactgctttcagctcatactactggctctacaaggctggcgtgactccagaaaccttcccaactgtctcacagttccttttcgaactagggaagcaaccaaggggtaccaagaaaatgaagaaggcactcttgagcactccaatgaagtgggggaagaagctctatgagctctttgctgatgattctttccagcagaacaggatctacatgcatcctgctgtgttgacagctggcagaatcagtgagatgggtgtttgctttggaacaatccctgtggccaatcctgatgatgccgcccagggatccggacacaccaagtccattcttaatcttcgaacaaacaccgagaccaacaatccgtgtgccaagacaattgtcaagttgtttgaaattcaaaaaacagggtttaacatacaggacatggacattgtagcctctgagcacctgctgcaccagtctcttgtcggcaagcagtctccattccaaaatgcctacaatgtcaagggcaacgctacaagtgccaacatcatctaa

SEQ ID NO: 3008 - RNA, 1449 nt, synthetic construct
  misc_feature 1..1449: note = derived and/or modified CDS sequence (wt) from CCHFV(UG3010)__DQ211650.1__N
  source 1..1449: mol_type = other RNA
atggagaataaaatcgaggtgaccagcaaggatgagatgaacaggtggtttgaagagttcaagaagagtaatggacttgtggacaccttcacaaactcttactccttttgtgagagtgtccctaaccttgacaggtttgtgtttcagatggccagtgccacagacgatgcacaaaaggactccatctatgcatctgctctagtagaggcaaccaagttttgtgcacctatatacgagtgtgcatgggtcagctccaccggcatagtcaagaaaggccttgagtggttcgaaaaaaatgcaggaaccatcaagtcttgggatgagagctatactgaacttaaagttggggtccccaagatagagcagcttgcaaactaccagcaggctgctctgaagtggaggaaggatattggtttccgtgtcaatgctaatacggcagccttgagcaacaaagtccttgcagagtataaagtccctggtgagattgtaatgtctgtcaaagagatgttgtctgacatgattagaagaaggaacttgatcctcaacagaggtggcgatgagaacccacgcggcccggtgagccgtgagcatgtggaatggtgcagggaatttgtcaagggcaagtacatcatggctttcaacccaccctggggagatattaacaagtcaggccgctcggggatagctcttgtcgcaacaggtcttgccaagcttgcagagactgaggggaaaggagtgtttgatgaagccaaaaaaactgttgaggaccttaatgggtatttggataagcacaaggatgaggttgacaaggccagtgctgacggcatggtgacaaacctcctcaagcacattgcaaaggcacaagagctctacaaaaattcatctgcactccgtgcacaaggcgcacagattgacactcctttcagctcattttactggctttacaaggctggcgtatctccagaaaccttcccaactgtttcacagtttctctttgagctggggaagcaaccaaggggcaccaagaaaatgaagaaggcactcctgagcactccaatgaagtggggaaagaaactctatgaactctttgcagatgattctttccaggagaacaggatctatatgcatcctgctgtgttgacagccggcagaatcagtgagatgggggtctgcttcggaaccatccccgtggctaaccctgatgacgctgcccagggatcaggacacaccaagtccattctcaaccttcggacaaacacagagactaacaatccatgtgctaagacaattgttaaactgtttgaaatccaaaagacaggattcaatatacaggatatggatattgtggcctctgaacatctgctgcatcagtctcttgttggaaagcagtctcctttccagaatgcctacaatgtcaaaggcaacgccaccagtgccaacattatctga

SEQ ID NO: 3009 - RNA, 1449 nt, synthetic construct
  misc_feature 1..1449: note = derived and/or modified CDS sequence (wt) from CCHFV(UGANDA 3010)__U88416.1__N
  source 1..1449: mol_type = other RNA
atggagaataaaatcgaggtgaccagcaaggatgagatgaacaggtggtttgaagagttcaagaagagtaatggacttgtggacaccttcacaaactcttactccttttgtgagagtgtccctaaccttgacaggtttgtgtttcagatggccagtgccacagacgatgcacaaaaggactccatctatgcatctgctctagtagaggcaaccaagttttgtgcacctatatacgagtgtgcatgggtcagctccaccggcatagtcaagaaaggccttgagtggttcgaaaaaaatgcaggaaccatcaagtcttgggatgagagctatactgaacttaaagttggggtccccaagatagagcagcttgcaaactaccagcaggctgctctgaagtggaggaaggatattggtttccgtgtcaatgctaatacggcagccttgagcaacaaagtccttgcagagtataaagtccctggtgagattgtaatgtctgtcaaagagatgttgtctgacatgattagaagaaggaacttgatcctcaacagaggtggcgatgagaacccacgcggcccggtgagccgtgagcatgtggaatggtgcagggaatttgtcaagggcaagtacatcatggctttcaacccaccctggggagatattaacaagtcaggccgctcggggatagctcttgtcgcaacaggtcttgccaagcttgcagagactgaggggaaaggagtgtttgatgaagccaaaaaaactgttgaggaccttaatgggtatttggataagcacaaggatgaggttgacaaggccagtgctgacggcatggtgacaaacctcctcaagcacattgcaaaggcacaagagctctacaaaaattcatctgcactcctgctgcaaggcgcacagattgacactcctttcagctcattttactggctttacaaggctggcgtatctccagaaaccttcccaactgtttcacagtttctctttgagctggggaagcaaccaaggggcaccaagaaaatgaagaaggcactcctgagcactccaatgaagtggggaaagaaactctatgaactctttgcagatgattctttccaggagaacaggatctatatgcatcctgctgtgttgacagccggcagaatcagtgagatgggggtctgcttcggaaccatccccgtggctaaccctgatgacgctgcccagggatcaggacacaccaagtccattctcaaccttgggacaaacacagagactaacaatccatgtgctaagacaattgttaaactgtttgaaatccaaaagacaggattcaatatacaggatatggatattgtggcctctgaacatctgctgcatcagtctcttgttggaaagcagtctcctttccagaatgcctacaatgtcaaaggcaacgccaccagtgccaacattatctga

SEQ ID NO: 3010 - RNA, 1449 nt, synthetic construct
  misc_feature 1..1449: note = derived and/or modified CDS sequence (wt) from CCHFV(UK ex Bulgaria)__KM201260.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagtgccactgatgatgcacagaaggactccatctatgcatcagctctggtggaagcaaccaggttctgtgcacctatatatgaatgtgcttgggtcagctctactggcattgtgaagaaggggcttgagtggttcgagaagaattcaggaaccatcaaatcttgggatgagaactatgctgagctgaaggttgatgttcccaaaatagaacaacttgccaattaccaacaggctgctctcaagtggaggaaggacataggtttccgcgtcaatgcaaacacggcagccttaagcaacaaagtccttgcagaatataaagtccctggcgaaattgtgatgtctgttaaagaaatgctgtcagacatgattagaaggaggaatctaattctcaacaggggcggtgatgaaaatccacgcggcccagtgagccgtgaacatgtggagtggtgcagggaatttgtcaaaggcaagtacatcatggccttcaatccaccttggggggacatcaacaaatcaggccgttcgggaatagcacttgttgcaacaggccttgccaagcttgcagagaccgaggggaaaggagtttttgacgaagctaagaagactgtggaggctctcaatgggtatttggacaagcacagggacgaagttgacaaagcaagtgctgacagcatgataacaaacctcttgaagcacattgccaaagcacaagagctttacaaaaattcatctgctcttcgtgcacaaggtgcacagattgacacccctttcagctcgttttactggctctacaaggccggtgtgactccggagaccttcccaactatctcacagttccttttcgaactggggaagcagccaaggggaaccaaaaaaatgaaaaaggcactcctgagcactccaatgaagtgggggaagaaactttatgagctctttgctgatgactctttccagcagaatagaatctacatgcaccctgctgtgttgacagccggtagaatcagtgaaatgggtgtctgctttggaacaatccctgttgccaatcctgatgacgctgctcagggatctggacataccaagtccattctcaatcttcggacaagcacagagaccaacaatccatgcgccaagacaattgtcaaattatttgaaatccaaaaaacaggatttaacatacaggacatggacattgtagcttctgaacacctgctgcaccaatcccttgttggcaagcagtctccattccaaaatgcctacaacgtcaagggcaatgccactagtgccaacatcatctaa

SEQ ID NO: 3011 - RNA, 1449 nt, synthetic construct
  misc_feature 1..1449: note = derived and/or modified CDS sequence (wt) from CCHFV(Yozgat19-2012)__KR092375.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtgccaaatctggataagtttgtgttccagatggccagcgccacggatgatgcacagaaggactccatctatgcatcggctctagtggaagcaaccaagttctgtgcacccatatatgaatgtgcttgggtcagctctactggtattgtgaagaaggggcttgagtggttcgagaagaattcaggaaccatcaaatcttgggatgagaactatgctgagctgaaggttgatgttcccaaaatagaacaacttgccaattaccaacaggctgctctcaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggagcggtgatgaaaatccacgcggcccagtaagccgtgaacatgtggagtggtgcagggaatttgtcaaaggcaagtacatcatggctttcaatccaccttggggggacatcaacaaatcaggtcgttcgggaatagcacttgttgcaacaggccttgccaagcttgcagagaccgaggggaaaggagtttttgacgaagctaagaagaccgtggaggctctcaatggatatttagacaagcacagggatgaagttgacaaagcaagtgctgacagcatgataacaaacctcctaaagcatattgccaaagcacaagagctttataaaaattcatctgctcttcgtgcacaaggcgcacagattgacacccctttcagctcgttttactggctctacaaggccggtgtgactccagagaccttcccaaccatctcacagttccttttcgaactggggaagcagccaagggggaccaaaaaaatgaaaaaggcactcctgagcactccaatgaagtgggggaagaaactttatgagctctttgctgatgactctttccagcagaacagaatctacatgcaccctgctgtgctgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaaaaaacaggatttaacatacaggacatggacattgtggcctctgagcacttgctgcaccaatcccttgttggcaagcagtctccgttccaaaatgcctaccacgtcaagggcaatgccaccagtgccaacatcatctaa

SEQ ID NO: 3012 - RNA, 1449 nt, synthetic construct
  misc_feature 1..1449: note = derived and/or modified CDS sequence (wt) from CCHFV(Yozgat207-2011)__KR092377.1__N
  source 1..1449: mol_type = other RNA
atggaaaacaagatcgaggtgaacagcaaagatgagatgaacaaatggtttgaggagtttaaaaagggaaatggacttatggacactttcacaaactcctactccttttgtgagaatgtaccaaatctggataagtttgtgttccagatggccagcgccacggatgatgcacagaaggactccatctatgcatcggctctagtggaagcaaccaagttctgtgcacccatatatgaatgtgcttgggtcagctctactggcattgtgaagaaggggcttgagtggttcgagaagaattcaggaaccatcaaatcttgggatgagaactacgctgagctgaaggttgatgttcccaaaatagaacaacttgccaattaccaacaggctgctctcaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggggcggtgatgaaaatccacgcggcccagtgagccgtgagcatgtggagtggtgcagggaatttgtcaaaggcaagtacatcatggctttcaatccaccttggggggacatcaacaaatcaggtcgttcgggaatagcacttgttgcaacaggccttgccaagcttgcagagaccgaggggaaaggagtttttgacgaagctaagaagaccgtggaggctctcaatgggtatttggacaaacacagggacgaagttgacaaagcaagtgctgacagcatgataacaaacctcctaaagcacattgccaaagcacaagagctttataaaaattcatctgctcttcgtgcacaaggtgcacagattgacacccctttcagctcgttttactggctctacaaggccggtgtgactccagagaccttcccaaccatctcacagttccttttcgaactggggaagcagccaagggggaccaaaaaaatgaaaaaagcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatccggatgatgctgctcagggatctggacataccaagtccattctcaaccttcggacaagcacagagaccaacaatccatgcgccaagacaattgtcaaattatttgaaatccaagaaacaggatttaacatacaggacatggacattgtggcctctgagcacttgctgcaccaatcccttgttggcaagcagtctccattccaaaatgcctacaacgtcaagggcaatgccaccagtgccaacatcatctaa

SEQ ID NO: 3013 - RNA, 1452 nt, synthetic construct
  misc_feature 1..1452: note = derived and/or modified CDS sequence (wt) from DUGV(ArD44313)__AF434161.1__N
  source 1..1452: mol_type = other RNA
atggagaatcagatcaaggcaaacaataaaaaagagtttgatgagtggtttaaaccttttagtgaaaagctccaattaaggtcaaacctcacaaactctgcatccctgtgtgatagagtacctgacctagctctagcagaaatgaaaatggcccttgccacagatgataaagaaaaagactcaatcttttctaatgctctggtggaggcaacacgtttctgtgctccaatctatgagtgtgcttggacctgcagtacaggtgtagtgcagaagagcttaagctggtttgataagaacaaagacttcatcaaactctgggacgcaaagtacatggatctcaaaaagggtatccctgaaccagagcaactagtttcataccagcaggcggcccaaaagtggagaaaggacgttggttatgaaattaaccaattcacaaggtctctcacacatccagttgttgcagagtacaaagtgcctggagaaattgctgttgatgtcaaagaaatgctgtctgacatgatcaggcgcaggaatgtcctgctgaacggagacggagaaaatgctgggaaaaaaggtcctatcagcagagagcatgtctcttggggccgtgagttggcaggaggaaagttccaagttgtgtttaaccctccttggggggatataaacaagtgtggtaaatcaggcattcctctagcagctactgccatggtgaaggttgctgagctagatgggtcaaagaagcttgaagatataaggcaggcccttctggatctaaaaaaatgggttgaagataacaaggatgcactagaggatgggaaaggcaatgagctcgtccagactatgacaaagcatctggctcaagcagtggaactatccaaaaagtccaatgccctgcgtgcacaaggagcacaaatagacactcctttctcagcctattattgggcttggagcgctggtgttaagccagagacatttttcactttgtctcaattcctctttgagatgggccagagtgctagaggaggcaaaaaaatgatcaaagcactgacttccacaccactaaggtggggcaagggattgattaacctgtttgcagatgatgactttttgggcaacagactatacatgcatcctgcagttctgactcctggtcgaatgagtgaaatgggtgcatgctttggggttattcctgttgcaagcccagaagatgcaatcctaggttcaggacactcaaaaaacatactgaacttcaaaattgataccagtgtacagaacccatgtgcatccacaatcgtgcaactgtacagaatccagaaatctggctttgatctagaaagcttagaagtagtgtctactgaacatcttttgcaccagtcatttgttggtaaaagatgcccaacccagaatgcttacaaggtgagaggaaatgcaaccaatgttaacatcatctaa

SEQ ID NO: 3014 - RNA, 1452 nt, synthetic construct
  misc_feature 1..1452: note = derived and/or modified CDS sequence (wt) from DUGV(ArD16095)__AF434162.1__N
  source 1..1452: mol_type = other RNA
atggagaatcagatcaaggcaaacaataaaaaagagtttgatgagtggtttaaaccttttagtgaaaagctccaattaaggtcaaacctcacaaactctgcatccctgtgtgatagagtacctgacctagctctagcagaaatgaaaatggcccttgccacagatgataaagaaaaagactcaatcttttctaatgctctggtggaggcaacacgtttctgtgctccaatctatgagtgtgcttggacctgcagtacaggcgtagtgcagaagagcttaagctggtttgataagaacaaagacttcatcaaactctgggactcaaagtacatggatctcagaaagggtatccctgaaccagagcaactagtttcataccagcaggcggcccaaaagtggagaaaggacgttggttatgaaattaaccaattcacaaggtctctcacacatccagttgttgcagagtacaaagtgcctggagaaattgctgttgatgtcaaagaaatgctgtctgacatgatcaggcgcaggaatgtcctgctgaacggagacggagaaaatgctgggaaaaaaggtcctatcagcagagagcatgtctcttggggccgtgagttggcaggaggaaagttccaagttgtgtttaatcctccttggggggatataaacaagtgtggtaaatcaggcattcctctagcagctactgccatggtgaaggttgctgagctagatgggtcaaagaagcttgaagatataaggcaggcccttctggatctaaaaaaatgggttgaagataacaaggatgcactagaggatgggaaaggcaatgagctcgtccagactatgacaaagcatctggctcaagcagtggaactatccaaaaagtccaatgccctgcgtgcacaaggagcacaaatagacactcctttctcagcctattattgggcttggagcgctggtgttaagccagagacatttttcactttgtctcaattcctctttgagatgggccagagtgctagaggaggcaaaaaaatgatcaaagcactgacttccacaccactaaggtggggtaagggattgattaacctgtttgcagatgatgacttttcgggcaacagactatacatgcatcctgcagttctgactcctggtcgaatgagtgaaatgggtgcatgctttggggttattcctgttgcaagcccagaagatgcaatcctaggttcaggacactcaaaaaacatactgaacttcaaaattgacaccagtgtgcagaacccatgtgcatccacaatcgtgcaactgtacagaatccagaaatctggctttgatctggaaagcttagaagtagtgtctactgaacatcttttgcaccagtcatttgttggtaaaagatgcccaacccagaatgcttacaaggtgagaggaaatgcaaccaatgttaacatcatctaa

SEQ ID NO: 3015 - RNA, 1452 nt, synthetic construct
  misc_feature 1..1452: note = derived and/or modified CDS sequence (wt) from DUGV(IbH11480)__AF434163.1__N
  source 1..1452: mol_type = other RNA
atggagaatcagatcaaggcaaacaataaaaaagagtttgatgagtggtttaaaccttttagtgaaaagctccaattaaggtcaaacctcacaaactctgcatccctgtgtgatagagtacctgacctagctctagcagaaatgaaaatggcccttgccacagatgataaagaaaaagactcaatcttttctaatgctctggtggaggcaacacgtttttgtgctccaatctatgagtgtgcttggacctgcagtacaggcgtagtgcagaagagcttaagctggtttgataagaacaaagacttcatcaagctctgggacgcaaagtacatggatctcagaaagggtatccctgaaccagagcaactagtttcataccagcaggcggcccaaaagtggagaaaggacgttggttatgaaattaaccaattcacaaggtctctcacacatccagttgttgcagagtacaaagtgcctggagaaattgctgttgatgtcaaagaaatgctgtctgacatgatcaggcgcaggaatgtcctgctgaacggagacggagaaaatgctgggaaaaagggtcctatcagcagagagcatgtctcttggggccgtgagttggcaggaggaaagttccaagttgtgtttaatcctccttggggggatataaacaagtgtggtaaatcaggcattcctctagcagctactgccatggtgaaggttgctgagctagatgggtcaaagaagcttgaagatataaggcaggcccttctggatctaaagaaatgggttgaagataacaaggatgcactagaggatgggaaaggcaatgagctcgtccagactatgacaaagcatctggctcaagcagtggaactatccaaaaagtccaatgccctgcgtgcacaaggagcacaaatagacactcctttctcagccttttattgggcttggagcgctggggttaagccagagacatttttcactttgtctcaattcctctttgagatgggccagagtgctagaggaggcaaaaaaatgatcaaagcactgacttccacaccactaaggtggggcaagggattgattaacctatttgcagatgatgactttttgggcaacagactatacatgcatcctgcagttctgactcctggtcgaatgagtgaaatgggtgcatgctttggggttattcctgttgcaagcccagaagatgcaatcctaggttcaggacactcaaaaaacatactgaacttcaaaattgacaccagtgtgcagaacccatgtgcatccacaatcgtgcaactatacagaatccagaaatctggctttgatctggaaagcttagaagtagtgtctactgaacatcttttgcaccagtcatttgttggtaaaagatgcccaacccagaatgcttacaaggtgagaggaaatgcaaccaatgttaacatcatctaa

SEQ ID NO: 3016 - RNA, 1452 nt, synthetic construct
  misc_feature 1..1452: note = derived and/or modified CDS sequence (wt) from DUGV(IbAr1792)__AF434164.1__N
  source 1..1452: mol_type = other RNA
atggagaatcagatcaaggcaaacaataaaaaagagtttgatgagtggtttaaaccttttagtgaaaagctccaattaaggtcaaacctcacaaactctgcatccctgtgtgatagagtacctgacctagctctagcagaaatgaaaatggcccttgccacagatgataaagaaaaagactcaatcttttctaatgctctggtggaggcaacacgtttctgtgctccaatttatgagtgtgcttggacctgcagtacaggcgtagtgcagaagagcttaagctggtttgataagaacaaagacttcatcaagctctgggacgcaaagtacatggatctcagaaagggtatccctgaaccagagcaactagtttcataccagcaggcggcccaaaagtggagaaaggacgttggttatgaaattaaccaattcacaaggtctctcacacatccagttgttgcagagtacaaagtgcctggagaaattgctgttgatgtcaaagaaatgctgtctgacatgatcaggcgcaggaatgtcctgctgaacggagacggagaaaatgctgggaaaaaaggtcctatcagcagagagcatgtctcttggggccgtgagttggcaggaggaaagttccaagttgtgtttaatcctccttggggggatataaacaagtgtggtaaatcaggcattcctctagcagctactgccatggtgaaggttgctgagctagatgggtcaaagaagcttgaagatataaggcaggcccttctagatctaaagaaatgggttgaagataacaaggatgcactagaggatgggaaaggcaatgagctcgtccagactatgacaaagcatctggctcaagcagtggaactatccaaaaagtccaatgccctgcgtgcacaaggagcacaaatagacactcctttctcagcctattattgggcttggagcgctggtgttaagccagagacatttttcactttgtctcaattcctctttgagatgggccagagtgctagaggaggcaaaaaaatgatcaaagcactgacttccacaccactaaggtggggcaagggattgattaacctgtttgcagatgatgactttttgggcaacagactatacatgcatcctgcagttctgactcctggtcgaatgagtgaaatgggtgcatgctttggggttattcctgttgcaagcccagaagatgcaatcctaggttcaggacactcaaaaaacatactgaacttcaaaattgacaccagtgtgcagaacccatgtgcatccacaatcgtgcaactatacagaatccagaaatctggctttgatctggaaagcttagaagtagtgtctactgaacatcttttgcaccagtcatttgttggtaaaagatgcccaacccagaatgcttacaaggtgagaggaaatgcaaccaatgttaacatcatctaa

SEQ ID NO: 3017 - RNA, 1452 nt, synthetic construct
  misc_feature 1..1452: note = derived and/or modified CDS sequence (wt) from DUGV(KT281/75)__AF434165.1__N
  source 1..1452: mol_type = other RNA
atggagaaccagatcaaggcaaacaccaaaaaagagtttgatgagtggttcaaaccttttagcgataagctccaattaagatcaaccctcacaaactccgcatctctctgtgatagagtgcctgacttagctctagcagaaatgaaaatggcccttgctacagatgataaagaaaaggactcaatcttttctaatgctctggtggaggcaacacgattctgtgctccaatctatgaatgtgcttggacctgcagcacaggcgtggtgcagaaaagcttaagctggtttgacaagaacaaagacttcatcaagctctgggatgcaaaatatatggatctcagaaagggaatccctgaaccagagcagctagtatcataccagcaagcagctcaaaagtggaggaaagacattggttatgagattaatcaattcacaaggtctctcacacatccggttgttgcagaatacaaggtgcctggagagattgctgttgatgtcaaggaaatgctatctgacatgatcagacgcagaaatgtcttgctgaatggagatggagaaaatgcagggaaaaaaggtcctatcagcagagagcatgtctcttggggccgtgagctggcagggggaaaattccaagttgtgtttaatcctccttggggagatataaacaagtgtggcaaatcaggcatccctctagcagccactgcaatggtgaaagttgcagagctggatgggtccaaaaaacttgaagatattaggcaggcccttctggatctaaaaaaatggattgaggacaacaaggatgcactggaggatggaaaaggcaatgaactcattcagaccatgacaaagcacctggctcaagcagtggaactgtccaagaagtccaatgcccttcgcgcacaaggagcacaaatagacactcccttttcagccttttactgggcttggagcgccggagttaagccagagacttttttcactttgtctcaattcctctttgagatgggacaaagtgctagaggaggcaaaaaaatgatcaaagcactgacatccacaccactaaggtggggtaaaggattgattaacttgtttgcagatgatgacttttctggcaacagactatacatgcacccggcagttctaactcctggtcgaatgagtgagatgggtgcatgcttcggggttattcctgttgcaagcccagaggatgcaatcttgggctcaggacactcaaaaaacatattgaacttcaagattgacaccagtgtgcaaaacccatgtgcatcaacaatagtgcaactatacagaatccagaaatctggctttgatctggaaagcttagaggtcgtgtccactgaacaccttttgcaccaatcatttgttggtaaaaggtgcccaactcagaatgcctacaaggtgagaggcaacgcaaccaatgttaacatcatctaa

SEQ ID NO: 3018 - RNA, 1452 nt, synthetic construct
  misc_feature 1..1452: note = derived and/or modified CDS sequence (wt) from DUGV(NJT130)__FJ422213.2__N
  source 1..1452: mol_type = other RNA
atggagaaccagatcaaagcaaacaacaaaaaagagtttgatgagtggttcaaaccctttagtgataagctccaattaaggtcaaccctcacaaactccgcatccctctgtgacaaagtgcctgacttggccctagcagaaatgaaaatggcccttgccacagacgataaagaaaaggactcaatcttttctaatgctctagtggaagcaacacgcttctgtgctccaatctatgaatgtgcatggacctgcagcacaggcgtggtacagaagagcttgagctggtttgataagaacaaagacttcatcaagctctgggatgcaaagtatatggatctcagaaagggtatccccgagccggagcagctagtctcataccagcaggcagctcaaaagtggaggaaggacattggctatgagatcaaccaattcacaaggtctctcacacatccggttgttgcagaatacaaagtgcctggagagattgctgttgatgtcaaggaaatgctatctgatatgatcagacgcagaaatgtcctgctgaatggagatggagagaatgctgggaaaaaaggtcctatcagcagagagcatgtctcttggggccgtgagctggcagaaggaaagttccaagttgtgtttaatcctccttggggggatataaacaagtgtggcaaatcaggcattcctctagcagctactgcaatggtgaaggttgcagagctggatgggtccaaaaaacttgaagatataagacaggcccttctggatctaaaaaaatgggttgaggacaacaaggacgcactggaggatggaaaaggcaatgagctcatccagaccatgacaaagcacctggctcaagcagtggaactgtccaaaaaatccaatgcccttcgcgcacaaggagcacaaatagacactcctttttcagccttttactgggcttggagcgctggggtcaagccggagacttttttcactctgtctcaattcctctttgagatggggcaaagtgctagaggaggcaaaaaaatgatcaaggcactgacatccacaccactaaggtggggcaagggattaattaacttgtttgcagatgatgacttttcaggtaacagactatacatgcatcctgcagttctaactcctggtcgtatgagtgaaatgggtgcatgctttggagttattcctgttgcaagcccagaagatgcaatcctgggttcagggcactcaaaaaacatactgaacttcaagattgacaccagtgtgcagaacccatgtgcatccacaatagtgcaactttacaggatccagaagtctggctttgacctggaaagcttggaggtagtgtccactgaacaccttttgcatcaatcatttgttggtaaaaggtgcccaactcagaatgcctacaaggtgagaggcaacgcaaccaatgttaacatcatctaa

SEQ ID NO: 3019 - RNA, 1452 nt, synthetic construct
  misc_feature 1..1452: note = derived and/or modified CDS sequence (wt) from DUGV(IbAr1792)__KU925457.1__N
  source 1..1452: mol_type = other RNA
atggagaatcagatcaaggcaaacaataaaaaagagtttgatgagtggtttaaaccttttagtgaaaagctccaattaaggtcaaacctcacaaactctgcatccctgtgtgatagagtacctgacctagctctagcagaaatgaaaatggcccttgccacagatgataaagaaaaagactcaatcttttctaatgctctggtggaggcaacacgtttctgtgctccaatttatgagtgtgcttggacctgcagtacaggcgtagtgcagaagagcttaagctggtttgataagaacaaagacttcatcaagctctgggacgcaaagtacatggatctcagaaagggtatccctgaaccagagcaactagtttcataccagcaggcggcccaaaagtggagaaaggacgttggttatgaaattaaccaattcacaaggtctctcacacatccagttgttgcagagtacaaagtgcctggagaaattgctgttgatgtcaaagaaatgctgtctgacatgatcaggcgcaggaatgtcctgctgaacggagacggagaaaatgctgggaaaaaaggtcctatcagcagagagcatgtctcttggggccgtgagttggcaggaggaaagttccaagttgtgtttaatcctccttggggggatataaacaagtgtggtaaatcaggcattcctctagcagctactgccatggtgaaggttgctgagctagatgggtcaaagaagcttgaagatataaggcaggcccttctagatctaaagaaatgggttgaagataacaaggatgcactagaggatgggaaaggcaatgagctcgtccagactatgacaaagcatctggctcaagcagtggaactatccaaaaagtccaatgccctgcgtgcacaaggagcacaaatagacactcctttctcagccttttattgggcttggagcgctggggttaagccagagacatttttcactttgtctcaattcctctttgagatgggccagaatgctagaggaggcaaaaaaatgatcaaagcactgacttccacaccactaaggtggggcaagggattgattaacctgtttgcagatgatgactttttgggcaacagactatacatgcatcctgcagttctgactcctggtcgaatgagtgaaatgggtgcatgctttggggttattcctgttgcaagcccagaagatgcaatcctaggttcaggacactcaaaaaacatactgaacttcaaaattgacaccagtgtgcagaacccatgtgcatccacaatcgtgcaactatacagaatccagaaatctggctttgatctggaaagcttagaagtagtgtctactgaacatcttttgcaccagtcatttgttggtaaaagatgcccaacccagaatgcttacaaggtgagaggaaatgcaaccaatgttaacatcatctaa

SEQ ID NO: 3020 - RNA, 1449 nt, synthetic construct
  misc_feature 1..1449: note = derived and/or modified CDS sequence (wt) from NSDV(Jilin)__NC_034386.1__N
  source 1..1449: mol_type = other RNA
atgcagaaccagattgttgcggacaacaaggatgccatccttgcatggcacaaaacctacagtgagaagcacagactcaagtctgttttgacaaactcagcttctttctgtgagactatacctgacttgtcggggtatgaggtcagcatgaggcttgtttcatcggagagtgagaaggactcagtgtatgcatctgccctggtggccgcgactaaattctgtgctcctatactggagtgtgcctggaccagctgcacggggatggtcgagcgtggtctggactggtttgaaaacaacaaggaaacagtgaagatttgggatgctgagtacgggaagctaagaacggaagcacccagccctgaacaactgctgggttaccagagagcagctcttaagtggagaaaggataccaagtacgggatcaacagaaatacagctgcactggccgctgcaattgcaaccgagtatagagtccctggatcaattgtggtgaatgtcaaggacatgctgtcggacatgatcaggagaaggaacaagatcctgaacagagacggcagtgaagatgttccgaaaaggggacccgtcagcaaagagcacattgactgggctagggaccttgctcaaggtaagttccttgttgtcttcaatccaccatggggtgatatcaacaaggcaggaaagtcagggattgccttagcagcgacaggtatggcaaaattgatagagctggatggtcccaaaattgcagaggacctgagggaatctctgaagggtcttgtggcatggatcaatgcccacaaggatgaagtggagaacggtaaagaggttgttgatggtttgaccaagcacctgcagaaagcccttgaattagccaagcaatcaagtgccatgagagcccaaggggctcagattgacactgtctttagcagctactactggctttggaaggcaggtgtgacagcggagatgtttccgacagtctcacagtttctttttgagctcggcaaggtgcccaggggaaataaaaaaatgaagaaagcactatcaagtatgcctctgaagtggggaaagaagttgctagcactctttgctgatgatagcttcactgctaatcggatttacatgcaccctggtgtcctaacagctgggagaatgtctgagctcggtgtttgcttcggagcaatcccagttgccaatcctgacgatgccgctgagggttcaggccacatcaagaatatactagcacaaaccactgacactcaggctggcaacccctgcgcacagaacatcgtcgccctattcaacattcagaaagccggcttcgacattgagagcatggacatagttgccttggagcatctgctacaccagtcactcgttggaaagagatctccttttcagaatgcctacaacatccggggaaatgccaccagcatccagatcatttaa

SEQ ID NO: 3021 - RNA, 1449 nt, synthetic construct
  misc_feature 1..1449: note = derived and/or modified CDS sequence (wt) from NSDV(62873)__HQ286609.1__N
  source 1..1449: mol_type = other RNA
atgcagaaccagattgtcgcagacaacaaggatgccatccttgcatggcacaaaacctacagcgagaagcacaaacttaagtctgttttgactaattcagcttctttctgtgaaaccatacctgatttgtcaggatatgaggttagcatgaggcttgtttcatctgaaagtgagaaagattcagtgtatgcttctgccttggttgctgcaactaaattctgtgctcctatcttagagtgcgcctggaccagctgcacagggatgattcaacgtggtcttgactggtttgagaacaacggggagatggtgaagatctgggatgccgattatgggaaattgagaacggagatacccagtcctgaacagttactgggttaccagagggctgctctaaagtggagaaaggacaccaaatatgggatcaacaaaaacacagcggcattggctgctgcaattgcaaccgagtacagagtccctggttcaattgtagtaaacgtcaaggacatgctatccgacatgattaggagaaggaacaaaatcctaaacagagacggcagtgaagacgttccaaagaggggacctgtcagcaaagagcacattgactgggccagagatcttgcacagggcaagttccttgttgttttcaacccaccatggggtgatatcaacaaggcagggaagtcaggaattgctctagcagcaaccggcatggcaaaattgatagagctggacggtcccaaagttgcagaggacttgaaagagtctctgaaaagcctcgtggcgtggatcaatgcccacaaggatgaagtggagaatggcaaagaggttgttgacggtttgaccaagcacctgcagaaagcccttgaactagccaagcagtcaagtgccatgagagctcaaggagcccagattgacactgtttttagcagctactactggctttggaaggcaggtgtgactgcagagatgttcccgacagtctcacagtttctctttgagctaggcaaggtgcccagagggaacaaaaaaatgaagaaagcactgtcaagcatgcctctgaaatggggaaagaaattacttgcactctttgctgatgatagcttcactgccaatcggatttacatgcaccctggagtcttgacagcgggaagaatgtcggagcttggcgtttgctttggggcaattccagtggccaatcctgatgatgcagctgagggttcaggtcatatcaagaacatactgaactacaagactgacacccaggctggtaacccctgtgcccagaacatcgttgccttgttcaacattcaaaaagcaggcttcgacattgagagcatggacatagttgcctcagagcatctgctgcatcagtcacttgttggaaagaggtccccttttcagaatgcatacaacatccgagggaatgccaccagtatccaaatcatctag

SEQ ID NO: 3022 - RNA, 1449 nt, synthetic construct
  misc_feature 1..1449: note = derived and/or modified CDS sequence (wt) from NSDV(779)__HQ286602.1__N
  source 1..1449: mol_type = other RNA
atgcagaaccagattgtcgcagacaacaaggatgccatccttgcatggcacaaaacctacagcgagaagcacaaacttaagtctgttttgactaattcagcttctttctgtgaaaccatacctgatttgtcaggatatgaggttagcatgaggcttgtttcatctgaaagtgagaaagattcagtatatgcttctgccttggttgctgcaactaagttctgtgctcctatcttagagtgcgcctggaccagctgcacagggatgatccaacgtggcctcgactggtttgataacaacggagagatggtgaagatctgggatgcagattatgggaaactgagaacggaggtacccagtcctgaacagttactaggttaccagagggctgctctaaagtggagaaaggacaccaaatatgggatcaacaaaaacacagcggcattggctgctgcaattgcaaccgagtacagagtccctggttcaattgtagtaaacgtcaaggacatgctatccgacatgattaggagaaggaacaaaatcctaaacagagacggcagtgaagacgttccaaagaggggacctgtcagcaaagagcacattgactgggccagagatcttgcacagggcaagttccttgttgttttcaacccaccatggggtgatatcaacaaggcagggaagtcaggaattgctctagcagcaaccggcatggcaaaattgatagagctggacggtcccaaagttgcagaggacttgaaagagtctctgaaaagcctcgtggcgtggatcaatgcccacaaggatgaagtggagaatggcaaagaggttgttgacggtttgaccaagcacctgcagaaagcccttgaactagccaagcagtcaagtgccatgagagctcaaggagcccagattgacactgtttttagcagctactactggctttggaaggcaggtgtgactgcagagatgttcccgacagtctcacagtttctctttgagctaggcaaggtgcccagagggaacaaaaaaatgaagaaagcactgtcaagcatgcctctgaaatggggaaagaaattacttgcactctttgctgatgatagcttcactgccaatcggatttacatgcaccctggagtcttgacagcgggaagaatgtcggagcttggcgtttgctttggggcaattccagtggccaatcctgatgatgcagctgagggttcaggtcatatcaagaacatactgaactacaagactgacacccaggctggtaacccctgtgcccagaacatcgttgccttgttcaacattcaaaaagcaggcttcgacattgagagcatggacatagttgcctcagagcatctgctgcatcagtcacttgttggaaagaggtccccttttcagaatgcctacaacatccgagggaatgccaccagtatccaaatcatctag

SEQ ID NO: 3023 - RNA, 1449 nt, synthetic construct
  misc_feature 1..1449: note = derived and/or modified CDS sequence (wt) from NSDV(6233)__HQ286603.1__N
  source 1..1449: mol_type = other RNA
atgcagaaccagattgtcgcagacaacaaggatgccatccttgcatggcataaaacctacagcgagaagcacaaacttaagtctgttttgactaattcagcttctttctgtgaaaccatacctgatttgtcaggatatgaggttagcatgaggcttgtttcatctgagagtgagaaagattctgtatatgcttctgccttggttgctgcaactaagttctgtgctcctatcttagagtgcgcctggaccagctgcacagggatgatccaacgtggcctcgactggtttgataacaacggagagatggtgaagatctgggatgcagattacgggaaactgagaacggaggtacccagtcctgaacagttactaggttaccagagggctgctctaaagtggagaaaggacaccaaatatgggatcaacaaaaacacagcggcattggctgctgcaattgcaaccgagtacagagtccctggttcaattgtagtaaacgtcaaggacatgctatccgacatgattaggagaaggaacaaaatcctgaacagagacggcagtgaagacgttccaaagaggggacctgtcagcaaagagcacattgactgggccagagatcttgcacagggcaagttccttgttgttttcaatccaccatggggtgatataaacaaggcaggtaagtcaggaattgctctagcagcaaccggcatggcaaaactgatagagctggacggtcccaaagttgcagaggacttgaaagagtctctgaaaagcctcgtggcatggatcaatgcccacaaggatgaagtggagaatggcaaggatgttgttgacggtttgaccaagcacctgcagaaagcccttgaactagccaagcagtcaagtgccatgagagctcagggagcccagattgacactgtttttagcagctactactggctctggaaggcaggtgtgactgcagagatgttcccgacagtctcacagtttctctttgagctaggcaaggtgcctagagggaacaaaaaaatgaagaaagcactgtcaagcatgcctctgaaatggggaaagaagttacttgcactctttgctgatgatagcttcactgccaatcggatttacatgcaccctggagtcttgacagcggggagaatgtcggagcttggtgtctgctttggggcaattccagtggccaatcctgatgacgcagctgagggttcaggtcatatcaagaacatactgaactacaagactgacacccaggctggtaacccctgtgcacagaacattgttgccctgttcaacattcaaaaagcaggcttcgacattgagagcatggacatagttgcctcagagcatctgctgcatcagtcacttgttggaaagaggtccccttttcagaatgcctacaacatccgagggaatgccaccagtatccaaatcatctaa

SEQ ID NO: 3024 - RNA, 1449 nt, synthetic construct
  misc_feature 1..1449: note = derived and/or modified CDS sequence (wt) from NSDV(40350)__HQ286608.1__N
  source 1..1449: mol_type = other RNA
atgcagaaccagattgtcgcagacagcaaggatgccatccttgcatggcacaaaacctacagcgagaagcacaaacttaagtctgttttgactaattcagcttctttctgtgaaaccatacctgacttgtcaggatatgaggttagtatgaggcttgtttcatctgatagtgagaaagattcagtgtatgcctctgccttggttgctgcaaccaaattctgtgctcctatcttggagtgcgcctggaccagctgcacagggatgattcaacgtggccttgactggtttgagaacaacggggagatggtgaagatctgggacgcagattatgggaaactgagaacggaggtgcccagtcctgaacaattgctgggttaccagagggctgccctaaagtggagaaaggacaccaaatatggaatcaataaaaacacagcagcattggctgctgcaattgcaactgaatatagagtccctggatcaattgtggtgaacgtcaaggacatgctatccgacatgattagaagaaggaacaaaattttgaacagagatggcagtgaagacgttccaaagaggggacctgtcagcaaagagcacattgactgggccagggatcttgctcagggcaagttccttgttgttttcaatccaccatggggtgacatcaacaaggcagggaagtcaggaattgctctagcagcaactggcatggcaaaactgatagagctggacggtcccaagattgcagaggacttgaaagagtctctgaaaagcctcgtggcatggatcaatgcccacaaggatgaagtggagaatggcaaagaggttgttgatggtctgaccaagcacctgcaaaaagcccttgaactggccaagcagtcaagtgccatgagagctcaaggagcccagattgataccgtctttagcagctactactggctttggaaagcaggtgtgactgcagagatgttcccgacagtctcacagttcctctttgagcttggcaaggtgcccagagggaacaaaaaaatgaagaaggcactgtcaagcatgcctctgaaatgggggaagaaactactcgcactttttgctgatgatagcttcactgccaatcggatctacatgcaccctggagtcctgacagcggggagaatgtcagagcttggtgtttgctttggagcaatcccagtagccaatcctgacgatgcagctgagggttctggtcatatcaagaacatactgaactacaagactgacactcaagctggcaacccttgtgcacagaacatcgttgccttgttcaacattcagaaggcaggctttgacattgagagcatggacatagttgcttcagagcatctgctgcatcagtcacttgttggaaagaggtccccctttcagaacgcttacaacatccgagggaatgccaccagcatccaaatcatctaa

SEQ ID NO: 3025 - RNA, 1449 nt, synthetic construct
  misc_feature 1..1449: note = derived and/or modified CDS sequence (wt) from NSDV(616287)__HQ286605.1__N
  source 1..1449: mol_type = other RNA
atgcagaaccagattgtcgcagacaacaaggatgccatccttgcatggcacaaaacctacagcgagaagcacaaacttaagtctgttttgactaattcagcttctttctgtgaaaccatacctgatttgtcaggatatgaggttagcatgaggcttgtttcatctgaaagtgagaaagattcagtatatgcttctgccttggttgctgcaactaagttctgtgctcctatcctagagtgcgcctggaccagctgcacagggatgatccaacgtggcctcgactggtttgataacaacggagagatggtgaagatctgggatgcagattatgggaaactgagaacggaggtacccagtcctgaacagttactaggttaccagagggctgctctaaagtggagaaaggacaccaaatatgggatcaacaagaacacagcggcattggctgctgcaattgcaaccgaatatagagtccctggttcaattgtagtgaacgtcaaggacatgctatccgacatgattaggagaaggaacaaaatcctaaacagagatggcagtgaagatgttccaaagaagggacctgtcagcaaagagcacgttgactgggccagagatcttgcacagggcaagttccttgttgttttcaatccaccatggggtgatatcaacaaggcaggtaagtcaggaattgctctagcagcaaccggcatggcaaaactgatagagcttgacggtcccaaagttgcagaggacttgaaagagtctctgaaaagcctcgtggcatggatcaatgcccacaaggatgaagtggagaatggcaaagaagttgttgatggtttaaccaagcacctgcagaaagcccttgaactagccaagcagtcaagtgccatgagagctcaaggggcccagattgacactgtttttagcagctattactggctttggaaggcaggtgtgactgcagagatgttcccgacagtctcacagtttctctttgagctaggcaaggtgcccagagggaacaaaaaaatgaagaaagcactgtcaagcatgcctctgaaatggggaaagaaattacttgcactctttgctgatgatagcttcactgccaatcggatttacatgcaccctggggtcttgacagcggggagaatgtcggagcttggtgtttgctttggggcaattccagtggccaatcctgatgatgcagctgagggttcaggtcatatcaagaacatactgaactacaagaccgacacccaggctggcaacccctgtgcacagaacatcgttgccttgttcaacattcaaaaagcaggcttcgacattgagagcatggacatagttgcctcagagcatctgctgcatcagtcacttgttggaaagagatccccttttcagaatgcctacaacatccgagggaatgccaccagtatccaaatcatctaa

SEQ ID NO: 3026 - RNA, 1449 nt, synthetic construct
  misc_feature 1..1449: note = derived and/or modified CDS sequence (wt) from NSDV(615526)__HQ286606.1__N
  source 1..1449: mol_type = other RNA
atgcagaaccagattgtcgcagacaacaaggatgccatccttgcatggcacaaagcctacagtgagaagcataaacttaagtctgttttgactaattcagcttctttctgtgaaactatacctgacttgtcaggatatgaggttagcatgaggcttgtttcatctgagagtgagaaggattcagtgtatgcttctgccttggttgctgcaactaaattctgtgctcctatcctggagtgcgcttggaccagctgcacagggatgattcaacgtggccttgattggtttgatagcaacggggagatggtgaagatctgggatgccgattatggaaaactgagaacggaggtacccagtcctgaacagttactgggttaccagagggctgctctgaagtggagaaaggacaccaaatatgggatcaacaaaaacacagcagcattggctgccgcaattgcaactgagtatagagtccctggatcaattgtggtaaatgtcaaagacatgctatccgacatgattaggagaaggaacaaaatcttgaacagagatggcagtgaagatgttccaaagggaggacctgtcagcaaagagcacattgactgggccagggaccttgctcagggcaagttccttgttgttttcaatccaccatggggtgatatcaacaaggcagggaagtcaggaattgccctggcagcaaccggtatggcaaaactgatagagctggacggtcccaaaattgcagaggatttgaaagagtctctgaaaagcctcgtagcatggatcaatgcccacaaggatgaagtggagaatggcaaagaggttgttgatggtctgaccaagcacctacagaaagcccttgaactagccaagcagtcaagtgccatgagagcccaaggagctcagattgacactgtctttagcagctactactggctttggaaggcaggtgtgactgcagagatgttcccgacagtttcacagtttctctttgagcttggcaaggttcctagagggaacaaaaaaatgaaaaaggcactatcaagcatgcctctgaaatggggaaagaagctacttgcactatttgctgatgatagcttcactgccaatcggatttacatgcaccctggagtcctgacagcagggagaatgtcagagcttggtgtttgctttggggcaattccagtggccaaccctgacgatgcagctgagggttcaggacatatcaagaacatactgaactacaagactgacactcaggctggcaacccctgtgcacagaacatcgttgccttgttcaacatccaaaaagcaggcttcgacattgagagcatggacatagttgcctcagagcatctgctgcaccagtcactcgttggaaagagatccccctttcagaatgcttacaacatccgaggaaatgccaccagtattcaaatcatctaa

SEQ ID NO: 3027 - RNA, 1449 nt, synthetic construct
  misc_feature 1..1449: note = derived and/or modified CDS sequence (wt) from NSDV(708)__AF504293.1__N
  source 1..1449: mol_type = other RNA
atgcagaaccagattgtcgcagacaacaaggatgccattcttgcatggcacaaagcttacagcgagaagcacaaacttaaatctgttttgaccaattcagcttctttctgtgaagccataccggacctgtcagggtatgaggttagcatgaggcttgtttcatctgatagtgaaaaggattcagtgtatgcttctgccttggttgctgcaaccaaattttgtgctcctatattggagtgtgcctggactagctgtacaggaatggtcgaacgtggacttgactggtttgagaacaacagagagatggtaaaaatctgggacactgagtacgggaaactgagaacagaggtgcctagtccagaacagttgctaggttaccagagggctgccttaaagtggagaaaagacaccaagtatggaatcaacaaaaacacagcagcactagccgctgcaattgcaactgagtataaagtccctggatcacttgtggtaaatgttaaggacatgctatcagacatgattaggagaaggaacaagattctaaacagagatggcagtgaagatgttccaaaaagagggcctgttagcaaagagcacattgactgggccagggatcttgctcagggcaagttccttgttgttttcaatccaccatggggcgacatcaacaaggcaggaaaatcgggaattgctctggcagcaaccggtatggcaaagctaatagagctagacggtcctaaaattgcagaggacttgaaagagtctctgaaaagccttgtggcatggatcaatgcacacaaggatgaagtggagaatggcaaagaggttgttgatagtttgaccaaatacctgcaaaaagctcttgaactagccaagcaatcaagtgccatgagagcccaaggggctcagatcgacaccgtatttagtagctactactggctttggaaggcaggtgtgacagcagagatgtttccgacagtctcacagttcctctttgagcttggcaaggtgcccagaggaaacaaaaaaatgaaaaaagcactgtcaagtatgcctctgaaatggggaaagaagttactagcactctttgctgatgacagcttcactgccaatcggatttacatgcaccctggtgtcctgacagcaggaagaatgtctgagcttggtgtttgcttcggggcaattccagtagccaaccctgatgatgcagccgatggttcaggccatatcaagagtatactaaactataagactgacacccaggctggcaacccctgcgcacagaacattgtcgccctgttcaacatccaaaaggcaggctttgacattgagagcatggacattgttgcctcggagcatctgctgcatcagtcacttgtcggaaagaggtccccttttcagaatgcttacaacatccgagggaatgccaccagcattcagatcatctaa

SEQ ID NO: 3028 - RNA, 702 nt, synthetic construct
  misc_feature 1..702: note = derived and/or modified CDS sequence (wt) from BUNV__NC_001927.1__N
  source 1..702: mol_type = other RNA
atgattgagttggaatttcatgatgtcgctgctaacaccagcagtacttttgacccagaggtcgcatacgctaactttaagcgtgtccacaccactgggcttagttatgaccacatacgaatcttctacattaaaggacgcgagattaaaactagtctcgcaaaaagaagtgaatgggaagttacacttaaccttgggggctggaagattactgtatataatacgaattttcctggcaaccggaacaacccagttcctgacgatggtcttaccctccaccgcctcagtggattccttgccaggtacctacttgagaagatgctgaaagtcagtgaaccagagaaattgattattaaatcaaaaataatcaaccctttggctgaaaagaatgggatcacttggaatgatggagaggaagtttatctctctttcttcccaggatcagagatgttcttaggaactttcagattctaccccttagcaatcgggatctacaaagttcagcgcaaggaaatggaaccaaaataccttgagaaaacaatgcggcagaggtacatgggactagaagcagcaacttggactgttagtaaattgacagaagttcagtctgcactgacagttgtctctagcttaggttggaagaaaaccaatgttagtgcagctgccagggacttccttgctaaattcggaatcaacatgtaa

SEQ ID NO: 3029 - RNA, 702 nt, synthetic construct
  misc_feature 1..702: note = derived and/or modified CDS sequence (wt) from BUNV(SFCrEq231)__KP063894.1__N
  source 1..702: mol_type = other RNA
atgatcgagctagaatttaatgatgtcgctgctaacaccagcagtacttttgacccagaggttgcatacattaactttaagcgtatctacaccactgggcttagttatgaccacattcgaatcttctacattaaaggacgcgagattaaaactagtctcacaaaaagaagtgaatgggaggttacgcttaaccttgggggctggaaggttactgtatttaatacaaattttcctggcaaccggaacagtccagttccagacgatggtcttaccctccacagactcagtggattccttgcccggtacctacttgagaagattctgaaagtgagtgaaccagaaaagctgatcatcaagtccaaaataatcaaccctttggctgaaaaaaatgggattacatggtcagatggagaagaggtgtacctctcattcttcccaggatctgaaatgttcttaggaacattcaaattctatccattggcaatcggaatttacaaagtccagagaaaggaaatggaacctaaatacctggaaaaaaccatgaggcagagatacatgggcttggaagcatcaacatggacagtcagcaaggtgaatgaggttcagtctgctctgacggtagtttcaggacttggatggaagaaaacaaatgtaagtgctgctgctagggagttcctggcaaagtttggaatcaacatgtaa

SEQ ID NO: 3030 - RNA, 702 nt, synthetic construct
  misc_feature 1..702: note = derived and/or modified CDS sequence (wt) from BUNV(AMH001130)__JF961342.1__N
  source 1..702: mol_type = other RNA
atgattgagttagaatttcatgatgtcgctgctaacaccagcagtacttttgacccagaggtcgcatacgctaactttaagcgtgtccacaccactgggcttagttatgaccacatacgaatcttctacattaaaggacgcgaggttaaaactagtctcgcaaaaagaagtgaatgggaagttacacttaaccttgggggctggaagattactgtatataatacgaattttcctggcaaccggaacaacccagttcctgacgatggtcttaccctccaccgcctcagtggattccttgccaggtacctacttgagaagatgctaaaagtcagtgaaccagaaaaattgatcatcaaatcaaaaataatcaatccattagctgaaaaaaatgggatcacttggaatgatggggaggaagtttatctctcctttttcccaggatcagaaatgttcctaggaactttcagattctaccccttagcaattgggatctacaaagtccagcgcaaggaaatggaaccgaaataccttgaaaagacaatgcggcagaggtacatgggactagaagcagcaacttggactgttagtaagttgacagaagttcagtctgcattaacagttgtctccagcttgggttggaagaaaactaatgttagtgcagctgccagggacttccttgctaaatttggaattaacatgtaa

SEQ ID NO: 3031 - RNA, 702 nt, synthetic construct
  misc_feature 1..702: note = derived and/or modified CDS sequence (wt) from BUNV(ArB29051)__AM709778.1__N
  source 1..702: mol_type = other RNA
atgattgagttagaatttcatgatgtcgctgctaacaccagcagtacttttgacccagaggtcgcatacgctaactttaagcgtgtccacaccactgggcttagttatgaccacatacgaatcttctacattaaaggacgcgagattaaaactagtctcgcaaaaagaagtgaatgggaagttacacttaaccttgggggctggaagattactgtatataatacgaattttcctggcaaccggaacaacccagttcctgacgatggtcttaccctccaccgcctcagtggattccttgccaggtacctacttgagaagatgctaaaactcagtgaaccagaaaaattgatcatcaaatcaaaaataatcaatccattggctgaaaaaaatgggatcacttggaatgatggggaggaagtttatctctcctttttcccaggatcagaaatgttcctaggaactttcagattctaccccttagcaattgggatctacaaagtccagcgcaaggaaatggaaccgaaataccttgaaaagacaatgcggcagaggtacatgggactagaagcagcaacttggactgttagtaaattgacagaagttcagtctgcactgacagttgtctccagcttgggttggaagaaaactaatgttagtgcagctgccagggacttccttgctaaatttggaattaacatgtaa

SEQ ID NO: 3032 - RNA, 702 nt, synthetic construct
  misc_feature 1..702: note = derived and/or modified CDS sequence (wt) from BUNV(ArB28215)__AM711130.1__N
  source 1..702: mol_type = other RNA
atgattgagttggaatttaatgatgtcgctgttaacaccagcagttcttttgacccagaggcagcatacgctaactttaagcgtgtccacaccactgggcttagttacgaccacatacgaatcttctacattaaagggagagagattaaagttagtctctcaaaaagaagtgaatgggaagttacaattaaccttgggggctggaagattgctgtatataatacgaattttcctggcaacaggaacagcccagttcctgacgatggtcttaccctccaccgcctcagtggattccttgccaggttcttacttgagaagatgctgaaaatgagtgaaccagaaaaattaattataaaggcaaaaataatcaacccactggctgaaaaaaataggatcacctggaatgatggtgaagaggtttacctgtctttcttccctggctcagaaatgttcctaggtacatttaaattctacccattggcaattgggatttacaaagtgcaaaggaaagaaatggaaccgaaatattttgaaaaaactatgaggcagaggtacatgggccttgaagcatcaagctggacagtgagcaaattaactgatgttcaatcagcacttacagttgtttctggcttaggctggaagaaaaccaacgtgagcgctgcagccagagacttcctggctaaatttggcatcaatatgtaa

SEQ ID NO: 3033 - RNA, 702 nt, synthetic construct
  misc_feature 1..702: note = derived and/or modified CDS sequence (wt) from BUNV(Peurto Almendras)__AJ697960.1__N
  source 1..702: mol_type = other RNA
atgtctgaaattgcatttgatgatattggccaaattgcagcaagcactttcaatccggacaatcagtacataggctttaaaaaggtctttactattgggcttacttatgatcaaatcagaattttcttcctgaatgggaagaaggccaaggagacattatctaaaagaagtgaagaaactgtcactctgaatttcggtggctggaggattcctatcgttaatactcattttccggggaatcgaaatattgaccttgcagatgatgcactcactctgcacagagtaagcggctacttggccagatacttacttgaaaaggtcttgagcgcccaggaacctgagaaagtgattataaagacaagaataatcaatccaattgctgcttctaatgggatcacatgggatgatgggtatgaagtctatctctctttctttcctggctctgaatgttttctggaagcttttaaattctaccctctagccatcggaatctacaaagtgcagaagggaatgatggatgttaagttcctagaaaaaacaatgaggcaaaaatatgctggacttgatgcaactgtttggactcagcagaagtacacagacgtcatcaatgccctccttgttgtaaatggccttggctggaagaagtcaaacgtgagtgctgctgctaaagacttcctgtccaaattcggaattcagatttaa

SEQ ID NO: 3034 - RNA, 702 nt, synthetic construct
  misc_feature 1..702: note = derived and/or modified CDS sequence (wt) from BUNV__AF325122.1__N
  source 1..702: mol_type = other RNA
atgattgagctagaattcaatgatgtcgctgctaacaccagcagtacttttgacccagaggttgcatacattaactttaagcgtctctacaccactgggcttagttatgaccacattcgaatcttctacattaaaggacgcgagattaaaactagtctcgcaaaaagaagtgaatgggaggttacgcttaaccttgggggctggaaggttactgtatttaatacaaattttcctgggaacaggaacagtccagttccagacgatggtcttaccctccacagactcagtggataccttgccaggtatctacttgagaaaatactgaaggtaagtgacccagaaaagctgataataaaatcaaagataatcaatccacttgctgaaaaaaacggtattacttggtctgacggagaagaagtttacctctccttcttcccagggtctgaaatgttcttagggacattcagattttaccccttagcaattgggatttataaagttcagaggaaagaaatggaaccaaaatatcttgagaaaactatgcgccaaaggtacatgggattggaagcctcaacatggacagttagcaaattaaacgaggtccagtctgcactcactgtggtttcaggccttggttggaagaaaacaaatgtgagcagtgctgctagggaattcctagccaaatttggaattagcatgtaa

SEQ ID NO: 3035 - RNA, 702 nt, synthetic construct
  misc_feature 1..702: note = derived and/or modified CDS sequence (wt) from Ab-BUNV(Cu20-XJ)__KJ710424.1__N
  source 1..702: mol_type = other RNA
atgttggagctagaatttgaagatgtccctactaacatcgggagtacttttgaccctgaatcaggatacattaactttcagcgtaactacctgccaggggttacgcttgaccaaattcgtatcttctacattaaaggacgcgagattaaaaatagtctcgcaaaaagaagtgaatgggaagttacgcttaatcttgggggctggaaggtgcctgtactcaatacgaatttccctggaaacaggagcaatgcagtgcctgactacggtcttaccttccaccgcatcagcggataccttgccaggtacttacttggaaaataccttgcagaaactgaaccagaaaagctcataatgagaacaaaaatcatcaaccctcttgctgagaaaaatggcatcacctgggaaagtggaccagaggtttatctctcattcttccctggtgcagagatgttccttggaactttcaagttctatccacttgccattggaatctacaaagtgcagaggaaagagatggacccaaaattcctggaaaagacaatgcgccagaggtacctcggccttgatgctcagacatggacaacaactaagcttgatgaagtggagagagccctaaaagtggtctcagggcttggctggaagaaaaccaatgtcagcaatgctgcaagggaattcctgtctaagtttggaatcagaatgtaa

SEQ ID NO: 3036 - RNA, 702 nt, synthetic construct
  misc_feature 1..702: note = derived and/or modified CDS sequence (wt) from ANADV(2513 Irkutsk)__KT313716.1__N
  source 1..702: mol_type = other RNA
atgattgaattagaattcaatgatgtcgctgctaacaccagcagtacttttgacccagaggttgcatacattaactttaagcgtatctacaccactgggcttagttatgaccacattcgaatcttctacattaaaggacgcgagattaaaactagtctcgcaaagagaagtgagtgggaggttacgcttaaccttgggggctggaaggttactgtatttaatacaaattttcctggaaacaggaacagtccagttccagacgatggtcttaccctccacagactcagtggattccttgccaggtacctacttgagaagattctgaaggtgagtgacccagaaaagctgataataaagtcaaaaattataaacccattggctgagaaaaacgggattacctgggctgatggagaggaggtttatctctcattcttcccaggatctgagatgtttttgggaactttcagattttacccgctagcaattggcatatataaagtacagaggaaggagatggaacctaagtacctagaaaaaacaatgcgtcagagatatatgggtctagaagcctcaacctggacagtaagcaagctgaacgaggtgcagtctgcattgacagtagtttcaggtcttggttggaaaaagacaaacgttagcagtgcagctagagagttcctagctagatttggaattaatatgtaa

SEQ ID NO: 3037 - RNA, 702 nt, synthetic construct
  misc_feature 1..702: note = derived and/or modified CDS sequence (wt) from ANADV(EIV-23263Tyum)__KT313761.1__N
  source 1..702: mol_type = other RNA
atgattgaattagaattcaatgatgtcgctgctaacaccagcagtacttttgacccagaggttgcatacattaactttaagcgtatctacaccactgggcttagttatgaccacattcgaatcttctacattaaaggacgcgagattaaaactagtctcgcaaagagaagtgagtgggaggttacgcttaaccttgggggctggaagattactgtatttaatacaaattttcctggaaacaggaacagtccagttccagacgatggtcttaccctccacagactcagtggattccttgccaggtacctacttgagaagattctgaaggtgagtgatccagaaaagctgataataaagtcaaaaattataaacccattggcagagaaaaacgggattacctgggctgatggagaggaggtttatctctcattcttcccaggatctgaaatgttcttgggaactttcagattttacccgctagcaattggcatatataaagtacagaggaaggagatggaacctaagtacctagaaaaaacaatgcgtcagagatatatgggtctagaagcctcaacctggacagtaagcaagctgaacgaggtgcagtctgcattgacagtagtttcaggtcttggttggaaaaagacaaacgttagcagtgcagctagagagttcctagctagatttggaattaatatgtaa

SEQ ID NO: 3038 - RNA, 702 nt, synthetic construct
  misc_feature 1..702: note = derived and/or modified CDS sequence (wt) from BATV__X73464.1__N
  source 1..702: mol_type = other RNA
atgattgaattggaattcaatgatgtcgctgctaacaccagcagtacttttgacccagaggttgcatacattaactttaagcgtatctacaccactgggcttagttatgacaacattagaattttctacattaaaggacgcgagattaaaactagtctctcaaaaagaagtgaatgggaggttacgcttaaccttgggggctggaaggttactgtatttaatacaaattttcctgggaacaggaacagtccagttccagacgatggtcttaccctccacagactcagtggattccttgccaggtacttacttgagaagattctaaaagtgagtgacccggaaaaattgattataaaatcaaaaattgttaatccacttgcagaaaaaaacggtataacctgggcagatggggaggaggtttacctctcattctttccagggtctgaaatgttcttaggaactttcagattctatcccctagcaattggcatttacaaggtgcagaggaaagagatggagccaaagtatctggagaagaccatgcgccaaagatatatgggcttggaagcatcaacttggacagtcagtaagctgaacgaagttcagtctgcactgactgtagtatcaggacttgggtggaagaagacaaatgtgagcagtgccgctagagaattcctagcaaagtttggcatcagcatgtaa

SEQ ID NO: 3039 - RNA, 702 nt, synthetic construct
  misc_feature 1..702: note = derived and/or modified CDS sequence (wt) from BATV(668)__KT313687.1__N
  source 1..702: mol_type = other RNA
atgattgaattagaattcaatgatgtcgctgctaacaccagcagtacttttgacccagaggttgcataccttaactttaagcgtatctacaccactgggcttagttatgacaacattcgaatcttctacattaaaggacgcgagattaaagttagtctcgcaaaaagaagtgaatgggaggttacgcttaaccttgggggctggaaggttactgtatttaatacaaattttcctggaaacaggaacagtccagttccagacgatggtcttaccctccacagactcagtggattccttgccaggtacttacttgagaagattttgaaagtaagtgacccagaaaaattgatcataaaatccaaaattatcaacccgcttgctgagaaaaatggcataacctggtcggatggagaagaggtttacctctcattcttcccagggtctgagatgttcttaggaactttcagattttatcccctggcaattggcatttacaaggtgcaaaggaaggagatggagccaaagtatctggagaagaccatgcgtcaaaggtacatggggctggaagcatcaacttggacagtcagcaaattgaatgaagttcagtctgcattgactgttgtgtcaggacttggctggaagaaaacaaatgtaagcagtgctgctagagaattcctggcaaaattcggcatcaacatgtaa

SEQ ID NO: 3040 - RNA, 702 nt, synthetic construct
  misc_feature 1..702: note = derived and/or modified CDS sequence (wt) from BATV(804922)__FJ436805.1__N
  source 1..702: mol_type = other RNA
atgattgaattggaattcaatgatgtcgctgctaacaccagcagtacttttgacccagaggtcgcatacattaactttaagcgtatctacaccactgggcttagttatgacaacattagaatcttctacattaaaggacgcgagattaaaactagtctcgcaaaaagaagtgaatgggaggttacgcttaaccttgggggctggaaggttactgtatttaatacaaattttcctgggaacaggaacagtccagttccagacgatggtcttaccctccacagactcagtggattccttgccaggtacttacttgagaagattctgaaagtgagtgacccggaaaaattgattataaaatcaaaaattgttaatccgcttgcagagaaaaatggcataacctgggcagatggggaggaagtttacctctcattctttccaggatctgaaatgttcttgggaactttcagattctatcccttagcaattggcatttacaaagtgcagaggaaagagatggaaccaaagtatctggagaagaccatgcgccagagatatatgggtttggaagcatcaacttggacagtcagtaaactgaacgaagttcagtctgcactaactgtagtatcaggacttgggtggaagaagacaaatgtgagcagcgctgctagagaattcctagcaaagtttggcattagtatgtaa

SEQ ID NO: 3041 - RNA, 702 nt, synthetic construct
  misc_feature 1..702: note = derived and/or modified CDS sequence (wt) from BATV(8627-11)__FJ436802.1__N
  source 1..702: mol_type = other RNA
atgattgaattggaattcaatgatgtcgctgctaacaccagcagtacttttgacccagaggtcgcatacattaactttaagcgtatctacaccactgggcttagttatgacaacattagaatcttctacattaaaggacgcgagattaaaactagtctcgcaaaaagaagtgaatgggaggttacgcttaaccttgggggctggaaggttactgtatttaatacaaattttcctgggaacaggaacagtccagttccagacgatggtcttaccctccacagactcagtggattccttgccaggtacttacttgagaagattctgaaagtgagtgacccggaaaaattgattataaaatcaaaaattgttaatccgcttgcagagaaaaatggcataacctgggcagatggggaggaagtttacctctcattttttccaggatctgaaatgttcttgggaactttcagattctatcccttagcaattggcatttataaagtgcagaggaaagagatggaaccaaagtatctggagaagactatgcgccatagatatatgggtttggaagcatcaacttggacagtcagtaaactgaacgaagttcagtctgcactaactgtagtatcaggacttgggtggaagaagacaaatgtgagcagcgctgctagagaattcctagcaaaatttggcattagtatgtaa

SEQ ID NO: 3042 - RNA, 702 nt, synthetic construct
  misc_feature 1..702: note = derived and/or modified CDS sequence (wt) from BATV(G-20217)__FJ436806.1__N
  source 1..702: mol_type = other RNA
atgattgaattggaattcaatgatgtcgctgctaacaccagcagtacttttgacccagaggtcgcatacattaactttaagcgtatctacaccactgggcttagttatgacaacattagaatcttctacattaaaggacgcgagattaaaactagtctcgcaaaaagaagtgaatgggaggttacgcttaaccttgggggctggaaggttactgtatttaatacaaattttcctgggaacaggaacagtccagttccagacgatggtcttaccctccacagactcagtggattccttgccaggtacttacttgagaagattctgaaagtgagtgatccggaaaaattgattataaaatcaaaaattgttaatccgcttgcagagaaaaatggcataacctgggcagatggggaggaagtttacctctcattctttccagggtctgaaatgttcttaggaactttcagattctatcccttatcaattggcatttacaaagtgcagaggaaagagatggaaccaaagtatctggagaagaccatgcgccaaagatatatgggtttggaagcatcaacttggacagtcagtaaactgaacgaagttcagtctgcactaactgtagtatcaggacttgggtggaagaagacaaatgtgagcagtgctgctagagaattcctagcaaagtttggcattagcatgtaa

SEQ ID NO: 3043 - RNA, 702 nt, synthetic construct
  misc_feature 1..702: note = derived and/or modified CDS sequence (wt) from BATV(MS50)__JX846604.1__N
  source 1..702: mol_type = other RNA
atgattgagttagaatttaacgatgtcgctgctaacaccagcagtacttttgacccagaggtcgcatacgctaactttaagcgtgtccacaccactgggcttagttatgaccacgtacgaatcttctacattaaaggaagagagattaaaactagtctctcaaaaagaagtgaatgggaagttacacttaaccttgggggctggaagattgctgtatataatacgaattttcctagcaaccggaacaacccagttcctgacgatggtcttaccctccaccgcctcagtggataccttgccaggtacctatttgagaagattgtgaaagttagcgaaccagagaaactgctaataaaatcaaagattataaaccccctggctgagaaaaatgggatcacatgggcagatggtgaggagatttacctctcattcttcccaggctcggagatgttccttgggactttcaaattttaccccttggcaattggcatatacaaagtccagaggaaggagatggagccaaaatatctagaaaaaacaatgcgccagagatacatggggctggaagcagggacatggacggttagcaaggttaatgaagtacaggctgcagttaatgtagtctccacactaggttggaagaaaacaaatgtcagtgctgctgccagagaattcctggccaaatttggcattgctatgtaa

SEQ ID NO: 3044 - RNA, 702 nt, synthetic construct
  misc_feature 1..702: note = derived and/or modified CDS sequence (wt) from BATV(ON-1/E/94)__AB257761.1__N
  source 1..702: mol_type = other RNA
atgattgaattggaattcaatgatgtcgctgctaacaccagcagtacttttgacccagaggttgcatacattaactttaagcgtgtctacaccactgggcttagttatgacaacattagaatcttctacattaaaggacgcgagattaaaactagtctcgcaaaaagaagtgaatgggaggttacgcttaaccttgggggctggaaggttactgtatttaatacaaattttcctgggaacaggaacagtccagttccagacgatggtcttaccctccacagactcagtggattccttgccaggtacctacttgagaagattctgaaagtgagtgacccggaaaaattgatcataaaatcaaagattgttaatccgcttgcagaaaaaaatggtataacctgggcagatggggaggaggtttacctctcattctttccagggtctgaaatgttcttaggaactttcagattttatcccttagcaattggcatctacaaggtgcagaggaaagagatggagccaaaatatctggaaaagaccatgcgccagagatatatgggcttagaagcatcaacttggacagtcagtaagctgaacgaagttcagtctgcactgactgttgtatcaggacttggatggaagaagacaaatgtgagcagtgctgctagagagttcctagcaaagtttggcatcagcatgtaa

SEQ ID NO: 3045 - RNA, 702 nt, synthetic construct
  misc_feature 1..702: note = derived and/or modified CDS sequence (wt) from BATV(UgMP-6830)__JX846601.1__N
  source 1..702: mol_type = other RNA
atgattgaattggaatttaatgatgtcgctgctaacaccagcagtacttttgacccagaggttgcatacattaactttaagcgtatctacaccactgggcttagttatgacaacattagaatcttctacattaaaggacgcgagattaaaactagtctcgcaaaaagaagtgaatgggaggttacgcttaaccttgggggctggaaggttactgtatttaatacaaattttcctgggaacaggaacagtccagttccagacgatggtcttaccctccacagactcagtggattccttgccaggtacctacttgagaagattctgaaggtgagtgacccagaaaaactgattataaaatcaaaaattattaatccgcttgcagagaagaatggtataacctgggcagacggggaggaagtttatctctcattctttccagggtctgagatgttcttaggaactttcagattctatccattggcaattggcatttataaagtgcagaggaaggagatggaaccgaaatatctggagaagaccatgcgccaaagatacatggggttggaagcatcaacttggacagtcagtaaattgaacgaagttcaatctgcactgactgtggtgtcaggacttgggtggaagaaaacaaatgtaagcagtgctgctagagaattcctagcaaaattcggcatcagcatgtaa

SEQ ID NO: 3046 - RNA, 702 nt, synthetic construct
  misc_feature 1..702: note = derived and/or modified CDS sequence (wt) from BIRV(ArB2198)__AM711131.1__N
  source 1..702: mol_type = other RNA
atgattgagttggaatttcatcatgtcgctgctaacaccagcagtacttttgacccagaggtcgcatatgctaactttaagcgtatccacaccaatgggcttagttatgacaacatacgaatcttctacattaaaggacgcgagattaaaactagtctcgcaaagagaagtgaatgggaggttacacttaaccttgggggctggaaggttgctgtatacaatacgaattttcctggcaaccggaacaacccagttcctgacgatggtcttaccctccaccgcctcagtggattccttgccaggtatctacttgaaaaaatgctgaaagttagtgaaccagagaaattgattattaagacaaaaataataaatccattggctgaaaaaaatggcatcacatggaaagacggagaagaagtttacttatctttcttcccggggtcagaaatgttcttaggaactttcaaattctacccacttgcaatcggcatctacaaggttcaaaagaaggaaatggatccaaaatatctggaaaagacaatgcggcagcgctatatggggttagaagcatccacttggacagttagtaaagtctcagaagttcagagtgctttaacagttgtctcaagcttaggctggaagaaaaccaacgttactgctgcagctcgggacttctttgctaaattcggaataaacatgtaa

SEQ ID NO: 3047 - RNA, 702 nt, synthetic construct
  misc_feature 1..702: note = derived and/or modified CDS sequence (wt) from BOZOV(ArB13529)__AM711132.1__N
  source 1..702: mol_type = other RNA
atgattgagttggaatttaatgatgtcgctgctaacaccagcagtacttttgacccagaggcagcatacgctaactttaagcgtgtccacaccactgggcttacttatgaccacatacgaatcttctacattaaagggagcgagattaaaactagtctcgcaaaaagaagtgaatgggaagttacacttaaccttgggggctggaagattactgtatataatacgaattttcctggcaaccggaacaacccaagtcctgacgatggtcttaccctccacttcttttgtggattccttgccaagtccttacttgaaaagatgctgaaggtcagtgcaccggagaaattgattataaaatcaaaaataaccagccctttggctgaaaagaatgggatcacttggaatgatggagaggaggtttatctctctttcttccctggctcagagatgttcctaggtacatttcatttctaccctttgccaattggaatctaccaagggctccgcagagacttggaaccaaaatactttgggaaaacactgcggctgatgtacatgggactagaagcatcatcctggactgtgagtaaattgactgaagggcagtctgcactgacagttgtctctggcttaggctggaagaaaaccaatgttagtgctgcagccagagacttcctggctaagtttggcatcaacatgtaa

SEQ ID NO: 3048 - RNA, 702 nt, synthetic construct
  misc_feature 1..702: note = derived and/or modified CDS sequence (wt) from CVV__X73465.1__N
  source 1..702: mol_type = other RNA
atgattgagttggaatttaatgatgtcgctgctaacaccagcagtacttttgacccagagattgcatacgttaactttaagcgtatccacaccactgggcttagttatgaccacattcgaatcttctacattaaaggacgcgagattaaaactagtctcacaaaaagaagtgaatgggaggttacgcttaaccttgggggctggaaggttactgtatttaatacaaattttcctggcaacaggaacagtccagttccagacgatggtcttaccctccacagactcagtggataccttgccaggtacctacttgagaaaatactgaaggtgagtgacccagagaaagtcattataaaatcaaaaataataaatccactagctgaaaagaatggaataacctggtctgatggcgaagaggtttacctctctttctttcctggctcagagatgttcttaggaacatttaaattttaccctctggcaataggaatttacaaagttcagaggaaagagatggaacctaagtacttggagaagacaatgcgccagaggtatatggggctagaagcgtcaacctggacaatcagtaaagtcaatgaagttcaggctgcccttacagtggtttctgggctaggctggaagaagactaacgtcagtgctgcagccagagaattcttggcaaaatttggtatcagcatgtaa

SEQ ID NO: 3049 - RNA, 702 nt, synthetic construct
  misc_feature 1..702: note = derived and/or modified CDS sequence (wt) from CVV(10081)__KP835932.1__N
  source 1..702: mol_type = other RNA
atgattgagttggaatttaatgatgtcgctgctaacaccagcagtacttttgacccagagattgcatacgttaactttaagcgtatctacaccactgggcttagttatgaccacattcgaatcttctacattaaaggacgcgagattaaaactagtctcacaaaaagaagtgaatgggaggttacgcttaaccttgggggctggaagattactgtatttaatacaaattttcctggcaacaggaacagtccagttccagacgatggtcttaccctccacagactcagtggataccttgccaggtacctacttgagaaaatattgaaggtgagtgatccagagaaggtcattataaaatcaaaaataataaatccactggctgaaaagaatggaataacctggtctgatggcgaagaggtttacctctctttcttccctggctcagagatgttcttaggaacattcaagttttatcctctggcaataggaatttacaaagttcagaggaaagagatggagcctaagtacttagaaaagacaatgcgccagaggtatatggggctagaggcatcaacctggacaatcagtaaagtcaatgaagttcaggctgcccttacagtggtttctgggctaggctggaagaagactaacgtcagtgctgcagccagagaattcttggcaaaatttggtatcagcatgtaa

SEQ ID NO: 3050 - RNA, 702 nt, synthetic construct
  misc_feature 1..702: note = derived and/or modified CDS sequence (wt) from CHLV(CHLV-Mex07)__EU879062.3__N
  source 1..702: mol_type = other RNA
atgattgagttggaatttaatgatgtcgctgctaacaccagcagtacttttgacccagagattgcatacgttaactttaagcgtatctacaccactgggcttagttatgaccacattcgaatcttctacattaaaggacgcgagattaaaactagtctcacaaaaagaagtgaatgggaggttacgcttaaccttgggggctggaaggttactgtatttaatacaaattttcctggcaacaggaacagtccagttccagacgatggtcttaccctccacagactcagtggataccttgccaggtacttacttgagaaaatattgaaggtgagtgacccagagaaggtcattataaaatcaaaaataataaatccactagctgaaaagaatggaataacctggtctgatggcgaagaggtttacctctctttctttcctggctcagagatgttcttaggaacattcaagttttaccctctggcaataggaatttacaaagttcagaggaaggagatggaacctaagtacttggagaagacaatgcgccagaggtatatggggctagaggcatcaacctggacagtcagtaaagtcaatgaagttcaggctgcccttacagtggtttctgggctaggttggaagaagactaatgtcagtgctgcagccagagaattcttggcaaaatttggtatcagcatgtaa

SEQ ID NO: 3051 - RNA, 702 nt, synthetic construct
  misc_feature 1..702: note = derived and/or modified CDS sequence (wt) from GERV__M19420.1__N
  source 1..702: mol_type = other RNA
atgttggagttggaatttgaagatgtccctaataacatcgggagtacttttgacccagagtcaggatacactaactttcagcgtaactacctgccaggggttacgcttgaccaaattcgcatcttctacattaaaggacgcgagattaaaaatagtctctcaaaaagaagtgaatgggaagttacgcttaaccttgggggctggaaggtacctgtactcaatacgaatttccctggaaacaggaacaatgcagtgcctgactacggtcttaccttccaccgtatcagtggataccttgcccggtacctacttggaaagtaccttgcagagacagaaccagaaaagctcataatgagaacaaaaattgtgaaccctcttgctgagaagaatggcatcacatgggagagcgggccagaagtctacctgtccttcttcccaggtgctgaaatgttccttggaactttcagattctacccacttgccattgggatctacaaagtgcagaggaaagaaatggacccaaaatttctggagaagactatgcgccagaggtaccttggcattgatgctcagacatggacaacaactaagcttggagaagtggaagcagctttaaaagtagtctcagggctcggatggaagaagacaaatgtcagcagtgctgcaagggagttcctatccaaattcggcatcaggatgtga

SEQ ID NO: 3052 - RNA, 702 nt, synthetic construct
  misc_feature 1..702: note = derived and/or modified CDS sequence (wt) from IACOV(BeAn314206)__JN572067.1__N
  source 1..702: mol_type = other RNA
atgtcggaaataatctttgatgatgttggccaaattacatccagcacattcaatcctgatgtgcagtatatcaattttaaaaagaatcatactacaggattgaattatgaccaaatcagagtttttttccttaatgggaagaaggctaaagaaacactggctaagagaagtgaggaaagtcttcaactgaactttggtggttggagagttgtagtcatgaacactcacttcccaggaaacaggaatatgctgattccagatgaagcaatgacattgcacaggctgagcggatatctggctagatatctgcttgagagaatcctatcagggcctgagcatgaaaaggttgtaattacttcaaagattgtcaacccaattgctgcttcaaatggaataacatggactgatgggcctgaagtctatttgtcatttttccctggaacagaaatgtttctagaatctttcaaattttaccctttggcaattggaatctacaaggttcaaaagaagatgatggaatcaaaatacttggaaaaggccatgaggcagaagtactctggaatggatgctacactttggacccagcagaaatatgctgaagtcacaaatgcacttgcagttgtgagcaatcttgggtggaagaagtcaaatgtcagtgctgctgcaagggatttccttgcaaaatttggaattcagctgtaa

SEQ ID NO: 3053 - RNA, 702 nt, synthetic construct
  misc_feature 1..702: note = derived and/or modified CDS sequence (wt) from ILEV(ArB16282)__AM709780.1__N
  source 1..702: mol_type = other RNA
atgattgaattagagtttcatgatgtcactgctaacaccagcagtacttttgacccagaggtcgcatacgctaactttaagcgtatccacaccaatgggcttaactacgaccacatacgaatcttctacattaaaggacgcgagattaaaactagtctcgcaaaaagaagtgaatgggaggttacacttaaccttgggggctggaagatttctgtatataatacgaaatttcctggcaaccggaacaacccagttcctgacgatggtcttaccctccaccgactcagtggattccttgccaggtacctacttgagaagatgcttaaagtcagtgaaccggaaaaattaattattaaatcaaaaataatcaaccctttggcggaaaaaaacgggatcacttggtatgatggagaggaagtttacctctctttcttccctggctctgagatgtgcctggggacccaagatttctaccccatggcaattgaattctaccaagtccaacgcaaagaaatggaaccgaaattccttgaaaaaacattgaagcaaagatccttgggactagaaccttcaacctggaccatcagccaattggtgaagttacaatcagccctaacagtggtctctggcttgggttggaagaaaactaatgtaggtgctgcagctaggaacttccttgctaaatttggaatcaacatgtaa

SEQ ID NO: 3054 - RNA, 702 nt, synthetic construct
  misc_feature 1..702: note = derived and/or modified CDS sequence (wt) from ILEV(HB80P125)__AM709779.1__N
  source 1..702: mol_type = other RNA
atgattgaattagagtttcatgatgtcactgctaacaccagcagtacttttgacccagaggtcgcatacgctaactttaagcgtatccacaccaatgggcttaactacgaccacatacgaatcttctacattaaaggacgcgagattaaaactagtctcgcaaaaagaagtgaatgggaggttacacttaaccttgggggctggaagattgccgtatataatacgaattttcctggcaaccggaacaacccagttcctgacgatggtctaaccctccaccgcctcagtggataccttgccaggtgcctacttgagaagatgctaaaagtcagtgaaccggaaaaacaaattatcaaatcaaaaattattaacccattggcagaaaaaaacggaataacttgggatgatggtgaagaagtttacttatctttcttccctggttctgagatgttcttagggacttttagattctacccattggcaattggaatctacaaagtccaacgcaaagagatggaaccgaaataccttgaaaaaacaatgagacaaagatacatgggcttggaagcatcaacctggaccatcagcaaattggcagaagtacaatcagccttaacagtggtctctggcttgggctggaagaaaactaatgttagtgctgcagctagagacttccttgctaaatttggaatcaacatgtaa

SEQ ID NO: 3055 - RNA, 702 nt, synthetic construct
  misc_feature 1..702: note = derived and/or modified CDS sequence (wt) from ILEV(ILESHA/8e)__KC608151.1__N
  source 1..702: mol_type = other RNA
atgattgaattagagtttcatgatgtcactgctaacaccagcagtacttttgacccagaggtcgcatacgctaactttaagcgtatccacaccaatgggcttaactacgaccacatacgaatcttctacattaaaggacgcgagattaaaactagtctcgcaaaaagaagtgaatgggaggttacacttaaccttgggggctggaagattgctgtatataatacgaattttcctggcaaccggaacaacccaattcctgacgatggtcttaccctccaccgcctcagtggataccttgccaggtacctacttgagaagatgctaaaagtcagtgaaccagaaaaacaaattatcaaatcaaaaattattaacccattggcagaaaaaaacggaataacttgggatgatggtgaagaagtttacttatctttcttccctggttctgagatgttcttggggacttttagattctacccattggcaattggaatctacaaagtccaacgcaaagagatggaaccgaaataccttgaaaaaacaatgagacaaagatacatgggcttagaagcatcaacctggaccatcagcaaattggcagaagtacaatcagccttaacagtggtctctggcttgggttggaagaaaactaatgttagtgctgcagctagagacttccttgctaaatttggaatcaacatgtaa

SEQ ID NO: 3056 - RNA, 702 nt, synthetic construct
  misc_feature 1..702: note = derived and/or modified CDS sequence (wt) from ILEV(R5964)__AY729651.1__N
  source 1..702: mol_type = other RNA
atgattgaattagagtttcatgatgtcactgctaacaccagcagtacttttgacccagaggtcgcatacgctaactttaagcgtatccacaccaatgggcttaactacgaccacatacgaatcttctacattaaaggacgcgagattaaaactagtctcgcaaaaagaagtgaatgggaggttacacttaaccttgggggctggaagattgctgtatataatacgaattttcctggcaaccggaacaacccaattcctgacgatggtcttaccctccaccgcctcagtggataccttgccaggtacctacttgagaagatgctaaaagtcagtgaaccagaaaaacaaattatcaaatcaaaaattattaacccattggcagaaaaaaacggaataacttgggatgatggtgaagaagtttacttatctttcttccctggttctgagatgttcttggggacttttagattctacccattggcaattggaatctacaaagtccaacgcaaagagatggaaccgaaataccttgaaaaaacaatgagacaaagatacatgggcttagaagcatcaacctggaccatcagcaaattggcagaagtacaatcagccttaacagtggtctctggcttgggttggaagaaaactaatgttagtgctccagctagagacttccttgctaaatttggaatcaacatgtaa

SEQ ID NO: 3057 - RNA, 702 nt, synthetic construct
  misc_feature 1..702: note = derived and/or modified CDS sequence (wt) from MAGV__D13783.1__N
  source 1..702: mol_type = other RNA
atgattgaacttgaattcaatgatgtcgctgctaacaccagcagtacttttgacccagagattgcatacgttaactttaagcgtatccacaccactgggcttagttatgaccacattcgagtcctctacattaaaggacgcgagattaaaactagtctcacaaaaagaagtgagtgggaggttacgcttaaccttgggggctggaaggttgctgtatttaatacaaattttcctggcaaccggaacagtccagttccagacgatggtcttaccctccacagactcagtggattccttgccaggtacctacttgagaaaattttaaaagtgagtgacccagaaaaacttatcatcaaatcaaaaataatcaaccctttggctgaaaaaaatggaataacatgggctgatggtgaggaggtatacctctcattctttccaggctcagaaatgttcttgggaacattcaaattctacccattggctatcggaatttacaaggttcagaagaaggaaatggaacctaaatatctggagaaaacaatgcgacagaggtacatgggtcttgaagcagctacatggacagttagcaaagtcaatgaagtccaggctgcacttacagttgtctctggattaggttggaagaaaactaatgtcagtgctgcggccagagagtttctggctaagtttggaattaacatgtaa

SEQ ID NO: 3058 - RNA, 702 nt, synthetic construct
  misc_feature 1..702: note = derived and/or modified CDS sequence (wt) from MAGV(7272)__KX100103.1__N
  source 1..702: mol_type = other RNA
atgattgaacttgaattcaatgatgtcgctgctaacaccagcagtacttttgacccagagattgcatacgttaactttaagcgtatccacaccactgggcttagttatgaccacattcgagtcctctacattaaaggacgcgagattaaaactagtctcacaaaaagaagtgagtgggaggttacgcttaaccttgggggctggaaggttgctgtatttaatacaaattttcctggcaaccggaacagtccagttccagacgatggtcttaccctccacagactcagtggattccttgccaggtacctacttgagaaaattttaaaagtgagtgacccagaaaaacttatcatcaaatcaaaaataatcaaccctttggctgaaaaaaatggaataacatgggctgatggtgaggaggtatacctctcattctttccaggctcagaaatgttcttgggaacattcaaattctacccattggctatcggaatttacaaggttcagaggaaggaaatggaacctaaatatctggagaaaacaatgcgacagaggtacatgggtcttgaagcagctacatggacagttagcaaagtcaatgaagtccaggctgcacttacagttgtctctggattaggttggaagaaaactaatgtcagtgctgcggccagagagtttctggctaagtttggaattaacatgtaa

SEQ ID NO: 3059 - RNA, 702 nt, synthetic construct
  misc_feature 1..702: note = derived and/or modified CDS sequence (wt) from MAGV(3363)__KX100106.1__N
  source 1..702: mol_type = other RNA
atgattgagttggaatttaatgatgtcgctgctaacaccagcagtacttttgacccagagattgcatacgttaactttaagcgtatctacaccactgggcttagttatgaccacattcgaatcttctacattaaaggacgcgagattaaaactagtctcacaaaaagaagtgaatgggaggttacgcttaaccttgggggctggaaggttactgtatttaatacaaattttcctggcaacaggaacagtccagttccagacgatggtcttaccctccacagactcagtggataccttgccaggtacctacttgagaaaatattgaaggtgagtgacccagagaaggtcattataaaatcaaaaataataaacccactggctgaaaagaatggaataacttggtctgatggcgaagaggtttatctctctttctttcctggctcagagatgttcttaggaacatttaagttctatcctctggcaataggaatttacaaagttcaaagaaaagagatggaacccaaatacttggagaagacaatgcgccagaggtatatggggctggaagcatcaacctggacaatcagtaaagtcaatgaagttcaggctgccctcacagtggtttctgggctgggctggaagaagacaaatgtcagtgctgcagccagggaattcttggcaaaatttggtatcagcatgtaa

SEQ ID NO: 3060 - RNA, 702 nt, synthetic construct
  misc_feature 1..702: note = derived and/or modified CDS sequence (wt) from NRIV(DakArY357/6e)__AY593727.1__N
  source 1..702: mol_type = other RNA
atgattgaattagagtttcatgatgtcactgctaacaccagcagtacttttgacccagaggttgcatacgctaactttaagcgtatccacaccaatgggcttaactacgactacatacgaatcttctacattaaaggacgcgagattaaaactagtctcgcaaaaagaagtgaatgggaggttacacttaaccttgggggctggaagattgctgtatataatacgaattttcctggcaaccggaacaacccaattcctgacgatggtcttaccctccaccgcctcagtggataccttgccaggtacctacttgagaagatgctaaaagtcagtgaaccggaaaaacaaattatcaaatcaaaaattattaacccattggcagaaaaaaacggaataacttgggatgatggtgaagaagtttacttatctttcttccctggttctgagatgttcttagggacttttagattctacccattggcaattggaatctacaaagtccaacgcaaagagatggaaccgaaataccttgaaaaaacaatgagacaaagatacatgggcttagaagcatcaacctggaccatcagcaaattggcagaagtacaatcagccttaacagtggtctctggcttgggttggaagaaaactaatgttagtgctgcagctagagacttccttgctaaatttggaatcaacatgtaa

SEQ ID NO: 3061 - RNA, 702 nt, synthetic construct
  misc_feature 1..702: note = derived and/or modified CDS sequence (wt) from NORV__X73470.1__N
  source 1..702: mol_type = other RNA
atgattgagcttgaatttaatgatgtcgctgctaacaccagcagtacttttgacccagaggttgcatacattaactttaagcgtgtctacaccactgggcttagttatgaccacattcgaatcttctacattaaaggacgtgagattaaaactagtctcacaaagagaagtgaatgggaggttacgcttaaccttgggggctggaaggttactgtatttaatacaaattttcctggcaacaggaacagtccagttccagacgatggtcttaccctccacagactcagtggattccttgccaggtacttacttgagaagatactgaaagtgagcgaaccagaaaaacttataatcaaatcaaaaataataaacccacttgcagaaaaaaatggcataacttggacagatggagaggaggtttacctgtctttcttccctggctcagagatgtttttaggaacattcaaattttacccattggctattggcatatataaagtacagaggaaggagatggaaccaaaatatctggaaaaaacaatgcgccagagatacatgggccttgaggcttctacttggaccatcagcaaagtcaatgaagtccaagctgcactcacagttgtttctggattgggatggaagaaaactaacgtcagtgctgcagccagagaattcctggctaaatttggaattaacatgtaa

SEQ ID NO: 3062 - RNA, 702 nt, synthetic construct
  misc_feature 1..702: note = derived and/or modified CDS sequence (wt) from POTV(89-3380)__AY729652.1__N
  source 1..702: mol_type = other RNA
atgatcgagttagaatttaatgatgtcgctgctgacaccagcagtacttttgacccagagattgcatacgttaactttaagcgtatccacaccactgggcttagttatgaccacattcgaatcttctacattaaaggacgcgagattaaaactagtctcacaaaaagaagtgaatgggaggttacgcttaaccttgggggctggaagattactgtatttaatacaaattttcctggcaaccggaacagtccagttccagacgatggtcttaccctccacagactcagtggataccttgccaggtacctacttgagaaaatactaaaagtgagtgacccagaaaaagtcatcataaaatcaaaaataataaacccccttgcagaaaaaaatggtataacctggtcagatggtgaggaggtttacctttccttcttccctggatcagaaatgttcttaggaacattcaaattctacccgttggcaattgggatctacaaagtccagcggaaagagatggagcccaaatacctagaaaaaacaatgcgtcagagatacatgggcctagaggcatcaacttggacagttagtaaggttaatgaagtgcaggctgctcttacagtagtctctggcttgggctggaagaaaacaaatgttagcgcagcagccagagaattcttggctaagtttggcatcagcatgtaa

SEQ ID NO: 3063 - RNA, 702 nt, synthetic construct
  misc_feature 1..702: note = derived and/or modified CDS sequence (wt) from SHOV(4042)__EU564831.1__N
  source 1..702: mol_type = other RNA
atgattgagttggaattccatgatgtcgctgctaacaccagcagtacttttgacccagaggtcgcatacgctaactttaagcgtgtccacaccactgggcttagttatgaccacatacgaatcttctacattaaaggacgcgagattaaaactagtctcgcaaaaagaagtgaatgggaggttacacttaaccttgggggctggaagattactgtatataatacgaattttcctggaaaccggaacaacccagttcctgacgatggtcttaccctccacagactcagtggattccttgccaggtacctacttgagaaaatgctgaaggtgagtgaaccagaaaaactgattataaaatcaaaaataatcaacccattggcagaaaaaaatggaataacctggactgatggagaggaagtttacctctcctttttcccaggagctgaaatgttcttagggacctttaaattctacccattggcaattggaatctacaaagtccagcgtaaagagatggagcctaaatacctggaaaaaacaatgaggcaaaggtacatgggcttggaagcagcaacttggactgttagcaagttaactgaagtccaggcggctctaacagttgtttcaggcttaggatggaagaaaactaacgtcagtgcagcagctcgagatttccttgctaagtttggaatcagcatgtaa

SEQ ID NO: 3064 - RNA, 702 nt, synthetic construct
  misc_feature 1..702: note = derived and/or modified CDS sequence (wt) from TENV(TSV-FE3-66FB)__FJ943505.1__N
  source 1..702: mol_type = other RNA
atgattgagctcgaattcaatgatgtcgctgctaacaccagcagtacttttgaccctgaggtcggatacgttaattttaagcgtgtccacaccactgggcttagttatgaccacatacgaatcttctacattaaaggacgtgagattaaaactagtctcacaaaaagaagtgaatgggaggttacgcttaaccttggggggtggaaggttactgtatttaatacaaattttcctggcaaccggaacagtccagttccagacgatggtcttaccctccacaggctcagtggattccttgccaggtatctacttgagaagatcctgaaggtgagtgacccagaaaaactgataataaaatcaaaaataattaacccattggctgaaaaaaatggaataacatgggcagatggtgaagaagtgtacctgtcattctttcctggatcggaaatgttccttggaacatttaaattctacccactggcaattggcatttacaaggtgcaaaggaaggagatggaacccaaatatctggaaaaaacaatgcggcagagatacatgggcttggaggctgctacctggacaatcagcaaggttaatgaagtccagtctgcactcacagtagtttctggcctaggctggaaaaagacaaatgtcagtgcagcagccagagagttcttggcaaaattcggaatcaatatgtaa

SEQ ID NO: 3065 - RNA, 702 nt, synthetic construct
  misc_feature 1..702: note = derived and/or modified CDS sequence (wt) from XINV(BeH388464)__EU564830.1__N
  source 1..702: mol_type = other RNA
atgctagagttggaattcaatgatgtcgctgctaacaccagcagtacttttgacccagaggtcggatatgctaattttaagcgtatccacaccaacgggcttagttacgacaacatacgaatcttctacattaaaggacgcgagattaaaactagtctcgcaaagagaagtgagtgggaggttacacttaaccttgggggctggaagattactgtatacaatacgaattttcctggcaaccggaaccacccaattcctgacgacggtcttaccatccaccgactcagtggatacttggccaggtatttacttgagaaaatattaaaagtcagtgatcctgaaaaattgcttattaaaacaaaaattatcaatccactggcagaaaaaaatgggatcacatggaatgatggtgaagaagtctatctttcattcttcccgggatctgagatgtttcttggaactttcaaattttatcctctcgcaattggaatttacaaggttcagcggaaagaaatggaacccaaatatcttgaaaaagcaatgcgtcaacgctacatgggattagagtcagctacatggactgtcagtaagctgaatgaagtgcaatcagcacttactgttgtatctggcttaggttggaagaaaacaaatgtgagtgctgctgctagagagtttttggctaaatttggcataaacatgtaa

SEQ ID NO: 3066 - RNA, 702 nt, synthetic construct
  misc_feature 1..702: note = derived and/or modified CDS sequence (wt) from NRIV(9800535)__JX857328.1__N
  source 1..702: mol_type = other RNA
atgattgagttagaatttcatgatgtcgctgctaacaccagcagtacttttgacccagaggtcgcatacgctaactttaagcgtgtccacaccactgggcttagttatgaccacatacgaatcttctacattaaaggacgcgagattaaaactagtctcgcaaaaagaagtgaatgggaagttacacttaaccttgggggctggaagattactgtatataatacgaattttcctggcaaccggaacaacccagttcctgacgatggtcttaccctccaccgcctcagtggattccttgccaggtacctacttgagaagatgctaaaagtcagtgaaccagaaaaattgatcatcaaatcaaaaataatcaatccattggctgaaaaaaacgggatcacttggaatgatggggaggaagtttacctctccttttttccaggatcagaaatgttcctaggaactttcagattctatcccttggcaattgggatctacaaagtccagcgcaaggaaatggaaccaaaataccttgaaaagacaatgcgacagaggtatatgggactagaagcagcaacttggactgttagtaaattgacagaagttcagtctgcattaacagttgtctccagcttgggttggaagaaaactaatgttagtgcagctgccagagacttccttgctaaatttggaatcaacatgtaa

SEQ ID NO: 3067 - RNA, 702 nt, synthetic construct
  misc_feature 1..702: note = derived and/or modified CDS sequence (wt) from NRIV(Adrar)__KJ716848.1__N
  source 1..702: mol_type = other RNA
atgattgagttagaatttcatgatgtcgctgctaacaccagcagtacttttgacccagaggtcgcatacgctaactttaagcgtatctacaccactgggcttagttatgaccacatacgaatcttctacattaaaggacgcgagattaaaactagtctcgcaaaaagaagtgagtgggaagttacacttaaccttgggggctggaagattactgtatataatacgaattttcctggcaaccggaacaacccagttcctgacgatggtcttaccctccaccgcctcagtggattccttgccaggtacctacttgagaaaatgctaaaagtcagtgaaccagaaaaattgatcatcaaatcaaaaataatcaatccattggcagaaaaaaatgggatcacttggaatgatggggaggaagtctacctctccttttttccaggatcagaaatgttcctaggaactttcagattctatcccttggcaattgggatctacaaagttcagcgcaaggaaatggaaccaaaataccttgaaaagacaatgcgacagagatatatgggactagaagcagcaacttggactgtcagtaaattgacagaagttcagtctgcactaacagttgtctccagcttgggttggaagaaaactaatgttagtgcagctgccagggatttccttgctaaatttggaatcaatatgtaa

SEQ ID NO: 3068 - RNA, 702 nt, synthetic construct
  misc_feature 1..702: note = derived and/or modified CDS sequence (wt) from NRIV(D28542/4e)__KC608154.1__N
  source 1..702: mol_type = other RNA
atgattgagttagaatttcatgatgtcgctgctaacaccagcagtacttttgacccagaggtcgcatacgctaactttaagcgtgtctacaccactgggcttagttatgaccacatacgaatcttctacattaaaggacgcgagattaaaactagtctcgcaaaaagaagtgaatgggaagttacacttaaccttgggggctggaagattactgtatataatacgaattttcctggcaaccggaacaacccagttcctgacgatggtcttaccctccaccgcctcagtggattccttgccaggtacctacttgagaagatgctaaaagtcagtgaaccagaaaaattgatcatcaaatcaaaaataatcaatccattggctgaaaaaaacgggatcacttggaatgatggggaggaagtttacctctccttttttccaggatcagaaatgttcctaggaactttcagattctatcccttggcaattgggatctacaaagtccagcgcaaggaaatggaaccaaaataccttgaaaagacaatgcgacagaggtatatgggactagaagcagcaacttggactgttagtaaattgacagaagttcagtctgcattaacagttgtctccagcttgggttggaagaaaactaatgttagtgcagctgccagggacttccttgctaaatttggaatcaacatgtaa

SEQ ID NO: 3069 - RNA, 702 nt, synthetic construct
  misc_feature 1..702: note = derived and/or modified CDS sequence (wt) from NRIV(SUD-HKV141)__JX857322.1__N
  source 1..702: mol_type = other RNA
atgattgagttagaatttcatgatgtcgctgctaacaccagcagtacttttgacccagaggtcgcatacgctaactttaagcgtgtccacaccactgggcttagttatgaccacatacgaatcttctacattaaaggacgcgagattaaaactagtctcgcaaaaagaagtgaatgggaagttacacttaaccttgggggctggaaggttactgtatataatacgaattttcctggcaaccggaacaacccagttcctgacgatggtcttaccctccaccgcctcagtggattccttgccaggtacctacttgagaagatgctaaaagtcagtgaaccagaaaaattgatcatcaaatcaaaaataatcaatccattggctgaaaaaaacgggatcacttggaatgatggggaggaagtttacctctccttttttccaggatcagaaatgttcttaggaactttcagattctatcccttggcaattgggatctacaaagttcagcgcaaggaaatggaaccaaaataccttgaaaagacaatgcgacagagatatatgggactagaagcagcaacttggactgttagtaaattgacagaagttcagtctgcattaacagttgtctccagcttgggttggaagaaaactaatgttagtgcagctgccagggacttccttgctaaatttggaatcaacatgtaa

SEQ ID NO: 3070 - RNA, 705 nt, synthetic construct
  misc_feature 1..705: note = derived and/or modified CDS sequence (wt) from BWAV(M459)__NC_034480.1__N
  source 1..705: mol_type = other RNA
atgtccgatttgatcttctatgatgtcgactcggttaatgccaatgagtttgaccctgatacaggatacctggattttaaaaataactatccaggggcactcaatacaaataccgctaggacattcttcctcaatgccgcaaaggccaagaatgtgctccgcaataaacctgacaagaaggtcaatcctaaatttggaaactgggaggtggaggttgtcaataatcattttcctggaaacaggaacaacccaattggtaaagatgatcttaccctccacagaatttcaggatatttagcaagatggattttggaggaatataagagagatgatgaatcagaaaaggaaatcattgaaagcacagttattaatccaatagctgaatcaaatgggattagatggagtgatggagcagagatatatctatcatttttccctggcacagagatgtttttggaaccattcaaattctatccactagcaattggcatatacagagtcaaacataagatgatggatgcacagttcctgaaaaaagccttgcggcagagatatgggaaaatgacagctgaaaaatggatgtcaacaaaagtgaagactataggtgaggctgttagaaatgtagaaaagctaaagtggggcaagggtggtttgagcgatgctgcaagaaacttcctaaagaagtttgacattgcaatgatataa

SEQ ID NO: 3071 - RNA, 705 nt, synthetic construct
  misc_feature 1..705: note = derived and/or modified CDS sequence (wt) from BWAV(M459)__EU564827.1__N
  source 1..705: mol_type = other RNA
atgtccgatttgatcttctatgatgtcgactcggttaatgccaatgagtttgaccctgatacaggatacctggattttaaaaataactatccaggggcactcaatacaaataccgctaggacattcttcctcaatgccgcaaaggccaagaatgtgctccgcaataaacctgacaagaaggtcaatcctaaatttggaaactgggaggtggaggttgtcaataatcattttcctggaaacaggaacaacccaattggtaaagatgatcttaccctccacagaatttcaggatatttagcaagatggattttggaggaatataagagagatgatgaatcagaaaaggaaatcattgaaagcacagttattaatccaatagctgaatcaaatgggattagatggagtgatggagcagagatatatctatcatttttccctggcacagagatgtttttggaaccattcaaattctatccactagcaattggcatatacagagtcaaacataagatgatggatgcacagttcctgaaaaaagccttgcggcagagatatgggaaaatgacagctgaaaaatggatgtcaacaaaagtgaaggctataggtgaggctgttagaaatgtagaaaagctaaagtggggcaagggtggtttgagcgatgctgcaagaaacttcctaaagaagtttgacattgcaatgatataa

SEQ ID NO: 3072 - RNA, 705 nt, synthetic construct
  misc_feature 1..705: note = derived and/or modified CDS sequence (wt) from BWAV(UgAr1888)__KJ867185.1__N
  source 1..705: mol_type = other RNA
atgtctgatttgatcttctatgatgtcgactcggttaatgccaatgagtttgaccctgatacaggatatctggattttaaaaataactatccaggggcactcaatacaaataccgctaggacattcttcctcaatgccgcaaaggccaagaatgtgctccgcaataaacctgacaagaaggtcaatcctaaatttggaaactgggaggtggagattgtcaataatcattttcctggaaacaggaacaacccaattggtaaagatgatcttaccctccacagaatttcaggatatttagcaagatggattttggaggaatataagagagatgatgaatcagaaaaagagatcattgaaagcacggtcattaatccaatagctgaatcaaatgggattagatggagtgatggagcagagatatatctatcatttttccctggcacagagatgtttttagaaccattcaaattctatccactagcaattggcatatacagagtcaaacataagatgatggatgcacagttcttgaaaaaagccttgcggcagagatatgggaaaatgacagctgaaaaatggatgtcaacaaaagtaaaggctataggtgaggccgttagaaatgtagaaaagctgaagtggggcaagggtggtttgagtgatgctgcaagaaacttcctgaagaagtttgatattgcaatgatataa

SEQ ID NO: 3073 - RNA, 708 nt, synthetic construct
  misc_feature 1..708: note = derived and/or modified CDS sequence (wt) from BWAV/PGAV(SAAr1)__EU564828.1__N
  source 1..708: mol_type = other RNA
atgtcgggagatctagttttttatgatgtcgactccgtcaattccaatgcgtttgatcctgatgcaggatatgtggcattttcaaacaaccatccaggggcgcttaatatcactacagctaggacatttttcctcaatgccgcaaaggccaagggtgtcctccgtaataaacctgacaagaaggttaaacctaaatttggagactgggaggtggagattgtcaataatcattttcctggaaacaggaacaatacaattggtgaagacgatcttaccctccacaggatttcaggatatttagctcgttgggttcttgaagaacattctaaagatgatgaaagtgagaaagaattaattgagagtacaattgtgaaccccattgctgagtcaaatgggataaagtggagcgatggtgcagcaatttacttatcattcttcccaggaactgaaatgtttcttgaaccgtttaagttctttccacttgcaattggaatctaccgcgttaagcataaaatgatggatgcccaattccttaagaaggccttgcgtcaaagatatgggaaacttacagcagaaaagtggatggcaacaaaggtcaaatcaattggagaagctgttagagctgtagagaaactgaagtggggaaaaggaggaattagtgatgcagccaggactttccttaagaaatttgatattgcactaatctaa

SEQ ID NO: 3074 - RNA, 708 nt, synthetic construct
  misc_feature 1..708: note = derived and/or modified CDS sequence (wt) from BWAV/PGAV(191B-07)__KJ867179.1__N
  source 1..708: mol_type = other RNA
atgtcgggagatctagttttttatgatgtcgactccgtcaattccaatgcgtttgatcctgatgcaggatatgtggcattttcaaacaaccatccaggggcgcttaatatcactacagctaggacattcttcctcaatgccgcaaaggccaagggtgtcctccgtaataaacctgacaagaaggttaaacctaaatttggagactgggaggtggagattgtcaataatcattttcctggaaacaggaacaatacaattggtgaagacgatcttaccctccacaggatttcaggatatttagctcgttgggttcttgaagaacattctaaagatgatgaaagtgagaaagaattaattgagagtacaattgtgaaccccattgctgaatcaaatgggataaagtggagcgatggtgcagcaatttacttatcattcttcccaggaactgaaatgtttcttgaaccatttaagttctttccacttgcaattggaatctaccgcgttaagcataaaatgatggatgcccaattccttaagaaggccttgcgtcaaagatatgggaaacttacagcagaaaagtggatggcaacaaaggtcaaatcaattggagaagctgttagagctgtagagaaactgaagtggggaaaaggaggaattagtgatgcagccaggaccttccttaagaaatttgatattgcactaatctaa

SEQ ID NO: 3075 - RNA, 708 nt, synthetic construct
  misc_feature 1..708: note = derived and/or modified CDS sequence (wt) from CEV(283)__KX817314.1__N
  source 1..708: mol_type = other RNA
atgtcggatttggttttctatgatgtcgcatccacaggtgcaaatggatttgatcctgatgcagggtatgtggacttctgtgctaaatatggggaatcaattaaccttgctgcagttaggatcttcttcctcaatgccgcaaaggccaaggctgctctctcgcgtaagccagagaggaaagctaatcctaaatttggcgagtggcaggtggaggttgtcaataatcattttccagcaaacaggaacaatccaattggtaacaatgatcttaccatccaccgcatctcaggataccttgctagatgggtcctagagcaatacaaagaaaatgaagacgaatctcagagagaactggtgaaaacaacagttatcaacccaattgctgaatcaaacggcatcagatgggagaatggtgcagaaatttatttggcattctttccaggaacagagatgttcttggaaacgttcaaattttaccctttaactattggaatctacagagtcaaaaatggaatgatggattcacagtatctgaagaaagccttaaggcagagatatggttcactaactgctgaaaaatggatgtcccagaagaccggcatgattgcaaagagtctgaaagaggttgagcagctcaagtggggtagaggtggtttgagtgacactgccaggactttccttcagaaattcgggataaagctgccataa

SEQ ID NO: 3076 - RNA, 708 nt, synthetic construct
  misc_feature 1..708: note = derived and/or modified CDS sequence (wt) from CEV(BFS-283)__U12797.1__N
  source 1..708: mol_type = other RNA
atgtcggacttggttttctatgatgtcgcatccacaggtgcaaatggatttgatcctgatgcagggtatgtggacttctgtgctaaacatggggaatcaattaaccttgctgcagttaggatcttcttcctcaatgccgcaaaggccaaggctgctctctcgcgtaagccagagaggaaagctaatcctaaatttggcgagtggcaggtggaggttgtcaataatcattttccagcaaacaggaacaatccaattggtaacaacgatcttaccatccaccgcatctcaggataccttgccagatgggtcctagagcaatacaaagaaaatgaagatgaatctcagagagaactggtgaaaacaacagttatcaacccaattgcggagtcaaatggcattagatgggagaatggtgcagaaatttatttggcattctttccaggaacagaaatgttcttggaaactttcaaattttaccctttgactattggaatctacagagtcaaaaatggaatgatggactcacagtatctgaagaaagccttgaggcagaggtatggttcactaactgctgaaaagtggatgtcccaaaagaccggcatgattgcaaagagtctaaaggaagtcgagcagcttaaatggggtaggggtggtttgagcgacactgctagaactttccttcagaaattcgggataaagttgccataa

SEQ ID NO: 3077 - RNA, 708 nt, synthetic construct
  misc_feature 1..708: note = derived and/or modified CDS sequence (wt) from CHATV(Mohko ILO8-3)__KF719221.1__N
  source 1..708: mol_type = other RNA
atgtcagatttagtgttttatgatgtcgcatcaacaggtgcaaatggatttgatcctgatgaagggtatatggcattctgtgttaaacatgcagaatcgatcagtcttgctgcagttaggatcttcttcctcaatgccgcaaaagccaaggctgctctcgcgcgtaagccagagaaaaaggcaagtcctaaatttggcgagtggcaggtggagattgtcaataatcattttcctggaaacaggaacaatccaattggtaacaacgatcttaccgtccacagattgtcaggatatctagccagatgggttcttgagcagtacaaggagaatgaggatgagtctcagcgcgagttgattaagacaactgtcatcaacccgattgctgagtctaatggggttagatgggatagtgggccagaaatctatttgtccttctttccaggaacagagatgtttttggaaacattcaaattttatccgctgaccattggaatatacagagtcaagcagggaatgatggaccctcagtacctgaagaaggcattgagacagcgctatggcacattgacagctgataagtggatgtcacaaaaggtgacagctattgctaagagcttgaaggaagtggaacagcttaagtggggaagaggagggctgagcgacactgcaaggacattcctgcagaagtttggcatcagactcccataa

SEQ ID NO: 3078 - RNA, 708 nt, synthetic construct
  misc_feature 1..708: note = derived and/or modified CDS sequence (wt) from CHATV(Mohko M07-1)__KF719224.1__N
  source 1..708: mol_type = other RNA
atgtcagatttagtgttttatgatgtcgcatcaacaggtgcaaatggatttgatcctgatgaagggtatatggcattctgtgttaaacatgcagaatcgatcaatcttgctgcagttaggatcttcttcctcaatgccgcaaaagccaaggctgctctcgcgcgtaaaccagagaaaaaggcaagtcctaaatttggcgagtggcaggtggagattgtcaataatcattttcctggaaacaggaacaatccaattggtaacaacgatcttaccgtccacagattgtcaggatatctagccagatgggttcttgagcagtacaaggagaatgaagatgagtctcagcgcgagttgattaagacaactgtcatcaacccgattgctgagtctaatggagtaagatgggatagtgggccggaaatctatttgtccttctttccaggaacagagatgtttttggaaacattcaaattttatccgctgaccattggaatatacagagtcaagcagggaatgatggatcctcagtacctgaagaaggcattgagacagcgctatggcacattgacagctgataagtggatgtcacaaaaggtgacggctattgctaagagcttgaaggaagtagaacagcttaagtggggaagaggagggctgagcgacactgcaaggacattcctgcagaagttcggcatcagactcccataa

SEQ ID NO: 3079 - RNA, 708 nt, synthetic construct
  misc_feature 1..708: note = derived and/or modified CDS sequence (wt) from CHATV(Mohko S07-2)__KF719233.1__N
  source 1..708: mol_type = other RNA
atgtcagatttagtgttttatgatgtcgcatcaacaggtgcaaatggatttgatcctgatgaagggtatatggcattctgtgttaaacatgcagaatcgatcaatcttgctgcagttaggatcttcttcctcaatgccgcaaaagccaaggctgctctcgcgcgtaaaccagagaaaaaggcaagtcctaaatttggcgagtggcaggtggagattgtcaataatcattttcctggaaacaggaacaatccaattggtaacaacgatcttaccgtccacagattgtcagggtatctagccagatgggttcttgagcagtacaaggagaatgaagatgagtctcagcgcgagttgattaagacaactgtcatcaacccgattgctgagtctaatggagtaagatgggatagtgggccggaaatctatttgtccttctttccaggaacagagatgtttttggaaacattcaaagtttatccgctgaccactggaatatacagagtcaagcagggaatgatggatcctcagtacctgaagaaggcattgagacagcgctatggcacattgacagctgataagtggatgtcacaaaaggtgacggctattgctaagagcttgaaggaagtagaacagcttaagtggggaagaggagggctgagcgacactgcaaggacattcctgcagaagttcggcatcagactcccataa

SEQ ID NO: 3080 - RNA, 708 nt, synthetic construct
  misc_feature 1..708: note = derived and/or modified CDS sequence (wt) from CHATV(LEIV-11483)__FJ853592.1__N
  source 1..708: mol_type = other RNA
atgtccgatttggtgttttatgatgtcgcatcaacaggtgcaaatggatttgatcctgatgaagggtatatggcattctgtgttaaacatgggcagtcggtcaatcttgctgcagttaggatcttcttcctcaatgccgcaaaagccaaggctgctctcgcacgtaagccagaaaagaaggcaagtcctaaatttggcgagtggcaggtggagattgtcaataatcattttcctggaaacaggaacaatccaattggtaacaacgatcttaccatccacagattgtcaggatatctagccagatgggtccttgagcagtacaaggagaatgaagatgagtctcagcgcgagttgattaaaacaactgtcataaacccgattgctgagtcaaatggagtgagatgggacagtggggcagagatctacttgtctttctttccagggactgagatgtttttggaaacattcaaattttacccgctgactattgggatttatagagtcaagcagggaatgatggaccctcagtacctgaagaaggctttgagacagcgctatggcacattgacagctgacaaatggatgtcacaaaaagtgacagctattgccaagagcttgaaggaagtagaacagcttaaatggggaagaggagggctgagtgacactgcaagaacattcctgcagaagtttggcatcagactcccatga

SEQ ID NO: 3081 - RNA, 708 nt, synthetic construct
  misc_feature 1..708: note = derived and/or modified CDS sequence (wt) from CHATV(LEIV-11552)__EU479702.1__N
  source 1..708: mol_type = other RNA
atgtccgatttggtgttttatgatgtcgcatcaacaggtgcaaatggatttgatcctgatgaagggtatatggcattctgtgttaaacatgggcagtcggtcaatcttgctgcagttaggatcttcttcctcaatgccgcaaaagccaaggctgctctcgcacgtaagccagaaaagaaggcaagtcctaaatttggcgagtggcaggtggagattgtcaataatcattttcctggaaacaggaacaatccaattggtaacaacgatcttaccatccacagattgtcaggatatctagccagatggatccttgagcagtacaaagagaatgaagatgagtctcagcgcgagttgattaaaacaactgtcataaacccgattgctgagtcaaatggagtgagatgggacagtggggcagagatctacttgtccttctttccagggactgagatgtttttggaaacattcaaattttacccgctgactattgggatttatagagtcaagcagggaatgatggaccctcaatacctgaagaaggctttgagacagcgctatggcacattgacagctgacaaatggatgtcacaaaaagtgacagctattgccaagagcttgaaggaagtagaacagcttaaatggggaagaggagggctgagtgacactgcaagaacattcctgcagaagtttggcatcagactcccatga

SEQ ID NO: 3082 - RNA, 708 nt, synthetic construct
  misc_feature 1..708: note = derived and/or modified CDS sequence (wt) from CHATV(LEIV-13107)__FJ946829.1__N
  source 1..708: mol_type = other RNA
atgtccgatttggtgttttatgatgtcgcatcaacaggtgcaaatggatttgatcctgatgaagggtatatggcattctgtgttaaacatgggcagtcggtcaatcttgctgcagttaggatcttcttcctcaatgccgcaaaggccaaggctgctctcgcgcgtaagccagaaaagaaggcaaatcctaaatttggcgagtggcaggtggagattgtcaataatcattttcctggaaacaggaacaatccaattggtaacaacgatcttaccatccacagattgtcaggatatctagccagatgggtccttgagcagtacaaggaaaatgaagatgagtctcagcgcgagttgattaaaacaactgtcatcaacccgattgctgagtcaaatggggtgagatgggacagtggggcagaggtctacttgtccttctttccagggactgagatgtttttggaaacattcaaattttacccgctgactattgggatttatagagtcaagcagggaatgatggaccctcagtacctgaaaaaggctttgagacagcgctacggcacattgacagccgacaaatggatgtcacaaaaagtgacagctattgccaagagcctgaaagaagtagagcagctcaaatggggaagaggagggctgagtgacactgcaagaacattcctgcagaagttcggcatcagactcccatga

SEQ ID NO: 3083 - RNA, 708 nt, synthetic construct
  misc_feature 1..708: note = derived and/or modified CDS sequence (wt) from CHATV(LEIV-17794)__FJ913879.1__N
  source 1..708: mol_type = other RNA
atgtccgatttggtgttttatgatgtcgcatcaacaggtgcaaatggatttgatcctgatgaagggtatatggcattctgtgttaaacatgggcagtcggtcaatcttgctgcagttaggatcttcttcctcaatgccgcaaaagccaaggctgctctcgcacgtaagccagaaaggaaggcaagtcctaaatttggcgagtggcaggtggagattgtcaataatcattttcctggaaacaggaacaatccaattggtaacaacgatcttaccatccacagattgtcaggatatctagccagatgggtccttgagcagtacaaggagaatgaagatgagtctcagcgcgagttgattaaaacaactgtcatcaacccgattgctgagtcaaatggggtgagatgggacagtggggcagagatctacttgtccttctttccagggactgagatgtttttggaaacattcaaattttacccgctgactattgggatttatagagtcaagcagggaatgatggatcctcagtacctgaagaaggctttgagacagcgctatggcacattgacagccgacaaatggatgtcacaaaaagtgacagctattgccaagagcttgaaggaagtagaacagctcaaatggggaaggggagggctgagtgacactgcaagaacattcctgcagaagttcggcatcagactcccatga

SEQ ID NO: 3084 - RNA, 708 nt, synthetic construct
  misc_feature 1..708: note = derived and/or modified CDS sequence (wt) from CHATV(LEIV-17827)__GQ330475.1__N
  source 1..708: mol_type = other RNA
atgtccgatttggtgttttatgatgtcgcatcaacaggtgcaaatggatttgatcctgatgaagggtatatggcattctgtgttaaatatggggaatcgatcaatcttgctgcagttaggatctttttcctcaatgccgcaaaagccaaggctgctctcgcgcgtaagccagaaaagaaggcaaatcctaaatttggcgagtggcaggtggagattgtcaataatcattttcctggaaacaggaacaatccaattggtaacaacgatcttaccatccacagattgtcaggatatctagccagatgggtccttgagcagtacaaggagaatgaagacgagtctcagcgcgagttgatcaaaacaactattatcaacccaatcgctgagtcaaatggagtgagatgggaaagcggggcagaggtgtacttgtcctttttccccggaactgagatgttcttagaaatattcaaattctacccgctgactattgggatatatagagtcaagcaagggatgatggaccctcagtacctaaagaaggccttgagacagcgctatggcacactgactgcagacaagtggatgtcacagaaagtgacagccattgccaagagcttaaaggaagtggagcagctcaagtggggaagaggaggactaagtgacaccgcaagaacattcctgcagaagttcggtattagactcccataa

SEQ ID NO: 3085 - RNA, 708 nt, synthetic construct
  misc_feature 1..708: note = derived and/or modified CDS sequence (wt) from CHATV(LEIV-17829)__GQ330476.1__N
  source 1..708: mol_type = other RNA
atgtccgatttggtgttttatgatgtcgcatcaacaggtgcaaatggatttgatcctgatgaagggtatatggcattctgtgttaaatatggggaatcgatcaatcttgctgcagttaggatctttttcctcaatgccgcaaaagccaaggctgctctcgcgcgtaagccagaaaaaaaggcaaatcctaaatttggcgagtggcaggtggagattgtcaataatcattttcctggaaacaggaacaatccaattggtaacaacgatcttaccatccacagattgtcaggatatctagccagatgggtccttgagcagtacaaggagaatgaagacgagtctcagcgcgagttgatcaaaacaactattatcaacccaatcgctgaatcaaatggagtgagatgggacagcggggcagaggtgtacttgtcctttttccccggaactgagatgttcttagaaatattcaaattctacccgctgactattgggatatatagagtcaagcaagggatgatggaccctcagtacctaaagaaggccttgagacagcgctatggcacactgactgcagacaagtggatgtcacagaaagtgacagccattgccaagagcttaaaggaagtggagcagctcaagtggggaagaggaggactaagtgacaccgcaagaacattcctgcagaagttcggtattagactcccataa

SEQ ID NO: 3086 - RNA, 708 nt, synthetic construct
  misc_feature 1..708: note = derived and/or modified CDS sequence (wt) from CHATV(LEIV-18733)__HQ734824.1__N
  source 1..708: mol_type = other RNA
atgtccgatttggtgttttatgatgtcgcatcaacaggtgcaaatggatttgatcctgatgaagggtatatggcattctgtgttaaatatggggaatcgatcaatcttgctgcagttaggatctttttcctcaatgccgcaaaagccaaggctgctctcgcgcgtaagccagaaaagaaggcaaatcctaaatttggcgagtggcaggtggagattatcaataatcattttcctggaaacaggaacaatccaattggtaacaacgatcttaccatccacagattgtcaggatatctagccagatgggtccttgagcagtacaaggagaatgaagacgagtctcagcgcgagttgatcaaaacaactattatcaacccaatcgctgagtcaaatggagtgagatgggacagcggggcagaggtgtacttgtcctttttccccggaactgagatgttcttagaaatattcaaattctacccgctgactattgggatatatagagtcaagcaagggatgatggaccctcagtacctaaagaaggccttgagacagcgctatggcacactgactgcagacaagtggatgtcacagaaagtgacagccattgccaagagcttaaaggaagtggagcagctcaagtggggaagaggagggctaagtgacaccgcaagaacattcctgcagaagttcggtattagactcccataa

SEQ ID NO: 3087 - RNA, 708 nt, synthetic construct
  misc_feature 1..708: note = derived and/or modified CDS sequence (wt) from CHATV(LEIV-18895)__GQ330482.1__N
  source 1..708: mol_type = other RNA
atgtctgatttggtgttttatgatgtcgcatcaacaggtgcaaatggatttgatcctgatgaagggtatatggcattctgtgttaaatatggggaatcgatcaatcttgctgcagttaggatctttttcctcaatgccgcaaaagccaaggctgctctcgcgcgtaagccagaaaggaaggcaaatcctaaatttggcgagtggcaggtggagattgtcaataatcattttcctggaaacaggaacaatccaattggtaacaacgatcttaccatccacagattgtcaggatacctagccagatgggtccttgagcagtacaaggagaatgaagacgagtctcagcgtgagttgatcaaaacaactattatcaacccaatcgctgagtcaaatggagtgagatgggacagcggggcagaggtgtacttgtccttcttccccggaactgagatgttcttggaaatattcaaattctacccgctgactattgggatatatagagtcaagcaagggctgatggaccctcagtacctaaagaaggccttgagacagcgctatggcacactgactgcagacaagtggatgtcacagaaagtaacagccattgccaagagcttaaaggaagtggagcagctcaagtggggaagaggaggactaagtgacaccgcaagaacattcctgcagaagttcggtattagactcccataa

SEQ ID NO: 3088 - RNA, 708 nt, synthetic construct
  misc_feature 1..708: note = derived and/or modified CDS sequence (wt) from CHATV(LEIV-22712)__HQ734825.1__N
  source 1..708: mol_type = other RNA
atgtctgacttagtgttttatgatgtcgcatcaacaggtgcaaatggatttgatcctgatgaagggtatatggcattctgtgttaaacatggagaatcaatcaatcttgctgcagttaggatcttcttcctcaatgccgcaaaagccaaagctgctctcgcgcgtaaaccagaaaaaaaggcaagtcctaaatttggcgagtggcaggtggagattatcaataatcattttcctggaaacaggaacaatccaattggtaacaacgatcttaccatccacagattgtcaggatatctagccagatgggtccttgagcagtacaaggaaaatgaagatgagtctcagcgcgaattgatcaaaacaactgtcatcaatccaatcgctgagtcaaatggggtaagatgggatagtggggcagaaatctacttgtccttctttccagggactgagatgtttttggaaacattcaaattttacccgctgaccatcgggatatatagagtcaagcaaggaatgatggatcctcagtacttgaagaaggcattaagacagcgctatggcacactgacagctgacaagtggatgtcacaaaaagtgacagctatagccaagagcttgaaggaagtagaacagcttaaatggggaagaggagggctgagtgatactgcaaggacattcctgcagaagttcggcatcaggctcccgtga

SEQ ID NO: 3089 - RNA, 708 nt, synthetic construct
  misc_feature 1..708: note = derived and/or modified CDS sequence (wt) from CHATV(LEIV-23500)__EU479701.1__N
  source 1..708: mol_type = other RNA
atgtccgatttggtgttttatgatgtcgcatcaacaggtgcaaatggatttgatcctgatgcagggtatatggcattctgtgttaagcatggggaatcgatcaaccttgctgcagttaggatctttttcctcaatgccgcaaaagccaaggctgctctcgcgcgtaagccagaaaaaaaggcaaatcctaaatttggcgagtggcaggtggagattgtcaataatcattttcctggaaacaggaacaacccaattggtaacaacgatcttaccatccacagactgtcaggatatctagccagatgggtccttgagcagtataaggaaaatgaagacgagtctcagcgtgagttgatcaaaacaactgtcatcaacccaattgctgagtcaaatggagtgagatgggaaaatggggcagaagtctacttgtcctttttcccagggactgagatgttcttagaaacattcaaattttacccgctgactattgggatatatagagtcaagcaaggaatgatggaccctcagtacctgaagaaggccttgagacagcgttatggcacattaacagctgataagtggatgtcacaaaaagtgacagccattgctaaaagcttgaaggaagtagaacagctcaagtggggaagaggaggcctgagtgacactgcaagaacattcctgcaaaagttcggcatcagactcccatga

SEQ ID NO: 3090 - RNA, 708 nt, synthetic construct
  misc_feature 1..708: note = derived and/or modified CDS sequence (wt) from INKV__Z68496.1__N
  source 1..708: mol_type = other RNA
atgggagatttggttttctatgatgaagcatccacaggtgcaaatggatttgatccagatgcagggtttgtggcatttatggctgaccatggagaatctatcaatttggcagccgttaggatcttcttccttaatgcagcaaaagccaaagctgctctcgctcgtaaaccggagcggaaagctactcctaaatttggagagtggcaggtggagattgtcaataatcattttcctggaaacaggaacaacccaattggtaacaacgatcttaccatccaccggctttctggatatttagcaagatgggtccttgagcatttcactgaagatgacgatgagtcccaaagagaactcataagaagcaccatcataaacccgattgcagaatcaaatggcattcattggaacaatggcccagaaatttatctttcattcttcccaggaacagaaatgtttctagaagttttcaaattctaccctttaaccattggaatttacagagtcaagcatggtatgatggatcctcagtacctaaagaaggcacttaggcaacgttatggcaccttgactgcagagaaatggatggcacagaagacagtgctcattgctaaaagcctaaaggatgttgagcagcttaaatggggaagaggaggacttagtgatgctgcaagaactttcttgatcaaatttggtgtaaagctgccttaa

SEQ ID NO: 3091 - RNA, 708 nt, synthetic construct
  misc_feature 1..708: note = derived and/or modified CDS sequence (wt) from INKV(KN3641)__U47137.1__N
  source 1..708: mol_type = other RNA
atgggagatttggttttctatgatgttgcatccacaggtgcaaatggatttgatccagatgcagggtttgtggcatttatggctgaccatggagaatctatcaatttggcagccgttaggatcttcttccttaatgcagcaaaagccaaagctgctctcgctcgtaaaccggagcggaaagctactcctaaatttggagagtggcaggtggagattgtcaataatcattttcctggaaacaggaacaacccaattggtaacaacgatcttaccatccaccggctttctggatatttagcaagatgggtccttgagcatttcactgaagatgacgatgagtcccaaagagaactcataagaagcaccatcataaacccgattgcagaatcaaatggcattcattggaacaatggcccagaaatttatctttcattcttcccaggaacagaaatgtttctagaagttttcaaattctaccctttaaccattggaatttacagagtcaagcatggtatgatggatcctcagtacctaaagaaggcacttaggcaacgttatggcaccttgactgcagagaaatggatggcacagaagacagtgctcattgctaaaagcctaaaggatgttgagcagcttaaatggggaagaggaggacttagtgatgctgcaagaactttcttgatcaaatttggtgtaaagctgccttaa

SEQ ID NO: 3092 - RNA, 708 nt, synthetic construct
  misc_feature 1..708: note = derived and/or modified CDS sequence (wt) from INKV(Lovanger)__KU302751.1__N
  source 1..708: mol_type = other RNA
atgggagatttggttttctatgatgtcgcatccacaggtgcaaatggatttgatccagatgcagggtttgtggcatttatggctgaccatggagaatctatcaatttggcagccgttaggatcttcttccttaatgcagcaaaagccaaagctgctctcgctcgtaaaccggagcggaaagctactcctaaatttggagagtggcaggtggagattgtcaataatcattttcctggaaacaggaacaacccaattggtaacaacgatcttaccatccatcggctttctggatacttagcaagatgggtccttgagcatttcactgaagatgacgatgagtcccaaagagaactcataaggagcaccatcataaacccgattgcagaatcaaatggcattcattggaacaatggcccagaaatttacctttcattcttcccaggaacagaaatgtttctagaagttttcaaattctaccctttaaccattggaatttacagagtcaagcatggtatgatggatcctcagtacctgaagaaggcacttaggcaacgctatggcaccttgactgcagagaaatggatgacacagaagacagtgctcattgctaaaagtctaaaggatgttgagcagcttaaatgggggagaggaggacttagtgatgctgcaagaaccttcctgatcaaatttggtgtaaaactgccttaa

SEQ ID NO: 3093 - RNA, 708 nt, synthetic construct
  misc_feature 1..708: note = derived and/or modified CDS sequence (wt) from INKV(SW AR 83-161)__U47138.1__N
  source 1..708: mol_type = other RNA
atgggagatttggttttctatgatgtcgcatccacaggtgcaaatggatttgatccagatgcagggtttgtggcatttatggctgaccatggagaatctattaatttggcagccgttaggatcttcttccttaatgcagcaaaagccaaagctgctctcgctcgtaaaccggagcggaaagctactcctaaatttggagagtggcaggtggagattgtcaataatcattttcctggaaacaggaacaacccaattggtaacaacgatcttaccatccaccggctttctggatacttagcaagatgggttcttgagcacttcactgaagatgacgatgagtcccaaagagaactcataaggagcaccatcataaacccaattgcagaatcgaatggcattcattggaacaatggcccagaaatttacctttcattcctcccaggaacagaaatgtttctagaagttttcaaattctaccctttaaccattgggatttacagagtcaagcatggtatgatggatcctcagtacctgaagaaggcacttaggcaacgctacggcaccttgactgcagagaaatggatggcacagaagacagtgctcattgctaaaagtctaaaggatgttgagcagcttaaatgggggagaggaggacttagtgatgctgcaagaaccttcctgatcaaatttggtgtaaaactgccttaa

SEQ ID NO: 3094 - RNA, 708 nt, synthetic construct
  misc_feature 1..708: note = derived and/or modified CDS sequence (wt) from LUMV__X73468.1__N
  source 1..708: mol_type = other RNA
atgtctgatttagtcttttatgatgtcgcatccaccggtgcaaatggatttgatcctgatgcagggtatgtggacttttgtgttaaacatggagaatcaatcaatctccattccgttaggatctttttccttaatgccgctaaggccaaggctgctctcgctcgtaagccggagaggaaggctagtcctaaatttggagagtggcaggtggagatcgtcaataatcattttcctggaaacaggaacaacccaattgataacaacgatcttaccatccaccggctgtcagggtatctggctagatgggtgttagagcagtttaaggaaaatgaagatgctgctcagagggaattgatcaagacaactgtcatcaacccaatagctgagtctaacggaatcagatgggacaatggggcagaaatatacctggcattctttccagggacagaaatgttcttggaaacattcaacttttacccgctgacaattggcatctacagagtcaagcatggaatgatggatccacagtacctaaaaaaggcattaaggcgacgctatggttccttgactgcagacaaatggatgtcgcaaaaaactgttgccatagccaaaagcctgaaggatgttgaacaactcaaatggggaagaggtggtctcagcgacaccgcaagagtattcctgcagaagtttggaatcaaacttccgtga

SEQ ID NO: 3095 - RNA, 708 nt, synthetic construct
  misc_feature 1..708: note = derived and/or modified CDS sequence (wt) from LUMV(SAAr 1881)__KX817326.1__N
  source 1..708: mol_type = other RNA
atgtctgatttagtcttttatgatgtcgcatccaccggtgcaaatggatttgatcctgatgcagggtatgtggacttttgtgttaaacatggagaatcaatcaatctccattccgttaggatctttttccttaatgccgctaaggccaaggctgctctcgctcgtaagccggagaggaaggctagtcctaaatttggagagtggcaggtggagatcgtcaataatcattttcctggaaacaggaacaacccaattgataacaacgatcttaccatccaccggctgtcagggtatctggctagatgggtgttagagcagtttaaggaaaatgaagatgctgctcagagggaattgatcaagacaactgtcatcaacccaatagctgagtctaacggaatcagatgggacaatggggcagaaatatacctggcattctttccagggacagaaatgttcttggaaacattcaacttttacccgctgacaattggcatctacagagtcaagcatggaatgatggatccacagtacctaaaaaaggcattaaggcaacgctatggttccttgactgcagacaaatggatgtcgcaaaaaactgttgccatagccaaaagcctgaaggatgttgaacaactcaaatggggaagaggtggtctcagcgacaccgcaagagtattcctgcagaagtttggaatcaaacttccgtga

SEQ ID NO: 3096 - RNA, 708 nt, synthetic construct
  misc_feature 1..708: note = derived and/or modified CDS sequence (wt) from MELV(TRVL 9375)__KX817329.1__N
  source 1..708: mol_type = other RNA
atgggagatttgatcttttatgatgtcgcatcaacaggtgcaaatggatttgatccagatgcagggtatctggcatttacaattgcgcatggggaagctatcaatttgtcagccgttaggatcttcttccttaatgccgcaaaagccaaagctgctctctctcgtaaaccggagaggaaagctactcctaaatttggagactggcaggtggaaattgtcaacaatcattttcctggaaacaggaacaacccaattggtaacaacgatcttaccatccatcggctttcaggatatcttgccagatgggtgctagatctgttcaaagaaaatgaagatgaatcccagaaggaattaatccagagcaccatcatcaatcctattgctgagtccaatgggatacactgggcaaatggggttgaaatatacctttcatttttcccagggactgaaatgtttctggaagccttcagattttatcctctaacaattggaatctacagagtcaaacacgggctgatggaccctcagtatctaaagaaggctctacgacagcgctatggcaccttgactgcagacaaatggatggcacaaaaaaccactatgattgctaaaagcctgaaggatgtagagcagctgaagtggggtaaggggggtcttagtgatgctgctagaacattccttcagaagttcggtgttagacttccataa

SEQ ID NO: 3097 - RNA, 708 nt, synthetic construct
  misc_feature 1..708: note = derived and/or modified CDS sequence (wt) from MBV__U31989.1__N
  source 1..708: mol_type = other RNA
atgtcggatttggttttttatgatgtcgcatccacaggtgcaaatggatttgatcctgatgcagggtatgtggacttctgtgctaaacatggggaatcgattaaccttgctgcagttaggatcttcttcctcaatgccgcaaaagccaaggctgctctctcgcgtaagccagagaggaaagctaatcctaaatttggcgagtggcaggtggagattgtcaataatcattttccagcaaacaggaacaatccaattggtaacaacgatcttaccatccaccgcatctcaggataccttgccagatgggtcctagagcaatacagagaaaatgaagatgagtcccaaagagaattggttaagacgacagtcatcaaccccattgctgagtctaatggcatcagatgggagaatggcccagaaatttatctggcattcttcccaggaaccgagatgttcttggagacattcaaattttatcctctaactattggaatttacagagttaaacatggaatgatggacccccaatatctaaagaaagcattaaggcagagatatggctccttaactgctgaaaagtggatgtcccagaagacaggcatgattgctaaaagcctaaaggaggttgagcaactcaagtggggcagaggtggtttgagcgatactgccaggactttccttcagaaatttggaataagactgccataa

SEQ ID NO: 3098 - RNA, 708 nt, synthetic construct
  misc_feature 1..708: note = derived and/or modified CDS sequence (wt) from SAV(VR723)__U47139.1__N
  source 1..708: mol_type = other RNA
atgtctgaattggttttctatgatgtcgcatcaaccggtgcaaatggatttgatcctgatgcagggtatctggcattctgtgttaaacatggggagtcgatcagtttgtcttcagttaggatcttcttcctcaatgccgcaaaagccaaagctgctctctcgcgtaaaccagagaggaaagcaaatcctaaatttggcgagtggcaggtggagattgtcaataatcattttcctggaaacaggaacaatccaattgacaacctcgatcttaccatccacagattgtctggatacctggctagatgggttctagagcagttcatcgagaatgaggatgaatcgcagagagagctgatcaagacgacagtcataaatcctattgcagaatcaaatgggataaaatgggaaaatggggcagaaatatacctgtctttctttccaggaacagagatgtttttggaaattttcaaattttacccgttgacaattgggatctacagagtaaagcagggaatgatggaccctcagtatttgaaaaaagctcttcggcagcgctatggttcgcttactgcagacaaatggatgtcccaaaaggttggtgcaattgctaaaagcttgaaggatattgagcagcttaagtggggcaaaggagggctcagtgatactgccagaactttcttgcagaagtttggtataaaattgccctaa

SEQ ID NO: 3099 - RNA, 708 nt, synthetic construct
  misc_feature 1..708: note = derived and/or modified CDS sequence (wt) from SDNV(BeAr 103645)__U47140.1__N
  source 1..708: mol_type = other RNA
atgggagatttggttttttatgatgtcgcatcaaccggtgcaaatggatttgatccagatgcagggtttgtggcatttatggctggtcatggggagtcgatcaatcttacagccgttagaatcttcttccttaatgccgcaaaagccaaagctgctctctctcgcaagccggagaggaaagctactcctaagtttggagactggcaggtggagattgtcaataatcattttcctggaaacaggaacaacccaattggtaacaacgatcttaccatccacagaatttcaggatatttagctcgctggacattagaacacttccgtgagggaggggatgaagctcagaaagaactaattcggacaacaatcattaaccctattgcagaatccaatggaatacattgggcaaatggagcagaaatttacctttcattcttcccaggaactgagatgtttcttgaggctttcaaattctacccactgacaattgggatatacagagtcaagcatggaatgatggatgcccagtacctgaagaaggcattgagacagcgatatggaaccctgacagcagacgagtggatggcacaaaaaactgttttaatcacaaaaagcctaaaggatgttgagcagttgaagtggggaagaggaggtttgagtgatgctgccagaacattcctatctaaatttggtgtcaagcttccataa

SEQ ID NO: 3100 - RNA, 708 nt, synthetic construct
  misc_feature 1..708: note = derived and/or modified CDS sequence (wt) from SDNV(BeAr 103645)__KX817335.1__N
  source 1..708: mol_type = other RNA
atgggagatttggttttttatgatgtcgcatcaaccggtgcaaatggatttgatccagatgcagggtttgtggcatttatggctggtcatggggagtcgatcaatcttacagccgttaggatcttcttccttaatgccgcaaaagccaaagctgctctctctcgcaagccggagaggaaagctactcctaagtttggagactggcaggtggagattgtcaataatcattttcctggaaacaggaacaacccaattggtaacaacgatcttaccatccacagaatctcaggatatttagctcgctggacattagaacacttccgtgagggagaggatgaagctcagaaagaactaattcggacaacaatcattaaccctattgcagaatccaatggaatacattgggcaaatggagcagaaatttacctttcattcttcccaggaactgagatgtttcttgaggctttcaaattctacccactgacaattgggatatacagagtcaagcatggaatgatggatgcccagtacctgaagaaggcattgagacagcgatatggaaccctgacagcagacaagtggatggcacaaaaaactgttttaatcacaaaaagcctaaaggatgttgagcagttgaagtggggaagaggaggtttgagtgatgctgccagaacattcctatctaaatttggtgtcaagcttccataa

SEQ ID NO: 3101 - RNA, 708 nt, synthetic construct
  misc_feature 1..708: note = derived and/or modified CDS sequence (wt) from SSHV__EU294510.1__N
  source 1..708: mol_type = other RNA
atgtccgatttggtgttttatgatgtcgcatcaacaggtgcaaatggatttgatcctgatgcagggtatatggcattctgtgttaaatatgcagaatcagtcaatcttgctgcagttaggatcttcttcctcaatgccgcaaaggccaaggctgctctctcgcgtaagccagagaggaaggcaaatcctaaatttggagagtggcaggtggaggttgtcaataatcattttcctggaaacaggaacaatccaattaacagcgacgatcttaccatccacagattgtcaggatatttagccagatgggttcttgagcagtataaagagaatgaagacgagtctcggcgtgagttgatcaagacaacaatcatcaaccccattgccgagtcaaatggagtgagatgggatagcggagcagagatctatctgtccttcttcccagggactgaaatgtttttggagaccttcaaattctacccgctgaccattggaatttacagagtcaagcagggaatgatggatcctcagtacctgaagaaggctttaagacaacgctatggttcactcacagcagacaagtggatgtcgcagaaggtgacggccattgccaagagcctgaaggaagtagagcagcttaagtggggaagaggagggctaagcgacactgccagatcattcttgcagaagttcggcatcaggctcccataa

SEQ ID NO: 3102 - RNA, 708 nt, synthetic construct
  misc_feature 1..708: note = derived and/or modified CDS sequence (wt) from SSHV(F10838)__KM215563.1__N
  source 1..708: mol_type = other RNA
atgtccgatttggtgttttatgatgtcgcatcaacaggtgcaaatggatttgatcctgatgcagggtatatggcattctgtgttaaatatgcagaatcagtcaatcttgctgcagttaggatcttcttcctcaatgccgcaaaggccaaggctgctctctcgcgtaagccagagaggaaggcaaatcctaaatttggagagtggcaggtggaggttgtcaataatcattttcctggaaacaggaacaatccaattaacagcgacgatcttaccatccacagattgtcaggatatttagccagatgggttcttgagcagtataaagagaatgaggacgagtctcggcgtgagttgatcaagacaacaatcatcaaccccattgccgagtcaaacggagtgagatgggatagcggagcagagatctatctgtccttcttcccagggactgaaatgtttttggaaaccttcaaattctacccgctgaccattgggatttacagagtcaagcagggaatgatggatcctcagtacctgaagaaggctctaagacaacgctatggttcactcacagcagacaagtggatgtcgcagaaggtgacggccattgccaagagcctgaaggaagtagagcagcttaagtggggaagaggagggctaagcgacactgccagatcattgttgcagaagttcggcatcaggctcccataa

SEQ ID NO: 3103 - RNA, 708 nt, synthetic construct
  misc_feature 1..708: note = derived and/or modified CDS sequence (wt) from SORV(SORV-252)__GU018050.2__N
  source 1..708: mol_type = other RNA
atgggagatttggtcttttatgatgtcgcatccacaggtgcaaatggatttgatccagatgcagggtttgtggcatttatggctgaccatggagaatctatcagtctgtcagccgttaggatcttcttccttaatgcagcaaaggccaaagctgctctcgctcgtaaaccggagcggaaggctaatcctaaatttggagagtggcaggtggagattgtcaataatcattttcctggaaacaggaacaacccaattggtaacaacgatcttaccatccatcggctttccggatatctagccagatgggttcttgagcattttacagaagatgaggacgagtcccaaagagagctgatacggagcaccattataaatccgattgcagaatccaatgggattcgttggaacaatggtccagaaatctatctttcatttttccctggaacagaaatgtttttggaggctttcaaattctaccctctaaccattggaatttacagagtcaagcatggtttgatggatcctcagtatttgaagaaagccctcaggcaacgctatggcaccttaactgccgaaaaatggatggcacaaaaaacagtacttattgccaaaagcttaaaagatgtggagcagcttaaatggggaagaggaggtctcagcgatgctgcaaggaccttcttgattaaatttggtgtgaaattgccttga

SEQ ID NO: 3104 - RNA, 708 nt, synthetic construct
  misc_feature 1..708: note = derived and/or modified CDS sequence (wt) from SORV(NJO 94F)__U47141.1__N
  source 1..708: mol_type = other RNA
atgggagatttggttttttatgatgtcgcatccacaggtgcaaatggatttgatccagatgcagggtttgtggcatttatggctgaccatggagaatctatcaatctgtcagccgttaggatcttcttccttaatgcagcaaaagccaaagctgctctcgctcgtaaaccggagcggaaggctaatcctaaatttggagagtggcaggtggagattgtcaataatcattttcctggaaacaggaacaacccaattggtaacaacgatcttaccatccaccggctttctggatatttagctagatgggttcttgagcattttacagaagatgaggatgaatcccagagggagcttatacgaagcaccatcataaatccaattgcagagtccaatggaattcattggaacaatggtccagaaatttacctttcattctttccaggaacagaaatgtttctggaagctttcaaattctaccctctaaccattggaatttacagagtcaaacatggtatgatggatccccaatacttaaagaaagccctcagacaacgctacggcaccttgacggctgaaaaatggatggcacagaagacagtgctcattgccaagagcctaaaggatgtggagcagcttaaatggggaagaggaggtctcagtgatgctgcaagaaccttcttgatcaaatttggtgtgaaattgccttga

SEQ ID NO: 3105 - RNA, 708 nt, synthetic construct
  misc_feature 1..708: note = derived and/or modified CDS sequence (wt) from SORV(NJO-94F)__KX817338.1__N
  source 1..708: mol_type = other RNA
atgggagatttggttttttatgatgtcgcatccacaggtgcaaatggatttgatccagatgcagggtttgtggcatttatggctgaccatggagaatctatcaatctgtcagccgttaggatcttcttccttaatgcagcaaaagccaaagctgctctcgctcgtaaaccggagcggaaggctaatcctaaatttggagagtggcaggtggagattgtcaataatcattttcctggaaacaggaacaacccaattggtaacaacgatcttaccatccaccggctttctggatatttagctagatgggttcttgagcattttacagaagatgaggatgaatcccagagggagcttatacgaagcaccatcataaatccaattgcagagtccaatggaattcattggaacaatggtccagaaatttacctttcattctttccaggaacagaaatgtttctggaagctttcaaattctaccctctaaccattggaatttacagagtcaaacatggtctgatggatccccaatacttaaagaaagccctcagacaacgctacggcaccttgacggctgaaaaatggatggcacagaagacagtgctcattgccaagagcctaaaggatgtggagcagcttaaatggggaagaggaggtctcagtgatgctgcaagaaccttcttgatcaaatttggtgtgaaattgccttga

SEQ ID NO: 3106 - RNA, 708 nt, synthetic construct
  misc_feature 1..708: note = derived and/or modified CDS sequence (wt) from TAHV__Z68497.1__N
  source 1..708: mol_type = other RNA
atgtctgatttggttttttatgatgtcgcatccaccggtgcaaatggatttgatcctgatgcagggtatgtggacttctgtattaaacatggggaagcaattaatctccattccgttaggatcttcttccttaatgccgcaaaagccaaagctgctctcgctcgtaagccggagaggaaggctagtcctaaatttggagagtggcaggtggaggtcgtcaattatcattttcctggaaacaggaacaacccaattgataacaacgatcttaccatccaccggctgtacgggtatttggctagatgggtgctagagcagttcaaagaaaatgaagacgcagctcaaagggagttgattaaaacaaccgttatcaaccccatagctgagtctaatgggatcaggtgggacaatggagcagaaatatatttggcattcttcccaggcacagaaatgtttctggaaacattcaatttttacccgctgacaattggcatttacagagtcaaacaaggaatgatggacccccagtatctgaagaaagcattgaggcagcgctatggctctcttactgcagacaagtggatgtcgcagaaaactactgccatagctaagagcctaaaggatgttgagcagcttaaatggggtagaggcggccttagcgacactgcaagaacattcttgcagaaatttggaatcagactcccataa

SEQ ID NO: 3107 - RNA, 708 nt, synthetic construct
  misc_feature 1..708: note = derived and/or modified CDS sequence (wt) from TAHV(22595-6)__HM036217.1__N
  source 1..708: mol_type = other RNA
atgtctgatttggttttttatgatgtcgcatccaccggtgcaaatggatttgatcctgatgcagggtatgtggacttctgtattaaacatggggaagcaattaatctccattccgttaggatcttcttccttaatgccgcaaaagccaaagctgctctcgctcgtaagccggagaggaaggctagtcctaaatttggagagtggcaggtggaggtcgtcaataatcattttcctggaaacaggaacaacccaattgataacaacgatcttaccatccaccggctgtcagggtatttggctagatgggtgctagagcagttcaaagaaaatgaagacgcagctcaaagggagttgattaaaacaaccgttatcaaccccatagctgagtctaatgggatcaggtgggacaatggagcagaaatatatttggcattcttcccaggcacagaaatgtttctggaaacattcaatttttacccgctgacaattggcatttacagagtcaaacaaggaatgatggacccccagtatctgaagaaagcattgaggcagcgctatggctctcttactgcagacaagtggatgtcgcagaaaactactgccatagctaagagcctaaaggatgttgagcagcttaaatggggtagaggcggccttagcgacactgcaagaacattcttgcagaaatttggaatcagactcccataa

SEQ ID NO: 3108 - RNA, 708 nt, synthetic construct
  misc_feature 1..708: note = derived and/or modified CDS sequence (wt) from TAHV(NM08003)__HQ541823.1__N
  source 1..708: mol_type = other RNA
atgtctgatttggttttttatgatgttgcatctaccggtgcaaatggatttgatcctgatgcagggtatgtggacttctgtattaaacatggggaagcaattaatctccattccgttaggatcttcttccttaatgccgcaaaagccaaggctgctctcgctcgtaagccagagaggaaggctagtcctaaatttggagagtggcaggtggaggttgtcaataatcattttcctggaaacaggaacaacccaattgataacaacgatcttaccatccaccggctgtcagggtatttggctagatgggtgctagagcagttcaaagagaatgatgacgcagctcaaagggagttgattaaaacaactgttatcaaccccatagctgagtctaatgggatcagatgggacaatggagcagaaatatatttggcattcttcccaggcacagaaatgttcctggagacattcaatttttacccgctgacaattggcatttacagagtcaagcaaggaatgatggacccccagtatctgaagaaggcactaaggcagcgctacggctctcttactgcagacaagtggatgtcgcagaagactactgccatagccaagagcctgaaggatgttgagcagcttaagtggggtagaggcggtcttagcgacactgcaagaacattcctgcagaaatttggaatcagactcccataa

SEQ ID NO: 3109 - RNA, 708 nt, synthetic construct
  misc_feature 1..708: note = derived and/or modified CDS sequence (wt) from TAHV(XJ0625)__EU622820.2__N
  source 1..708: mol_type = other RNA
atgtctgatttggttttttatgatgtcgcatccaccggtgcaaatggatttgatcctgacgcagggtatgtggacttctgtgttaaatatggggaagcaattaatctccattccgttaggatcttcttccttaatgccgcaaaagccaaggctgctctcgctcgtaagccagagaggaaggctagtcctaaatttggagagtggcaggtggaggttgtcaataatcattttcctggaaacaggaacaacccaattgataacaacgatcttaccatccaccggctgtcagggtatttggctagatgggtgctagagcagttcaaagaaaatgaggatgcagcccagcgggagttgatcaagacaacggtcatcaacccgatagctgaatccaatgggatcagatgggataatggagcagaaatctatttggcattcttcccgggaacagaaatgttcttggaaactttcaatttttacccgttgacaattggcatctacagagtcaagcaaggaatgatggatccccaatacttaaagaaggcattaaggcagcgctatgggcctctcactgcagacaaatggatgtcgcagaagaccgtcgccatagctaagagcctgaaggatgttgaacagctcaagtggggaagaggtggtctcagcgacactgcaagaacattcctgcagaaatttggaatcagacttccataa

SEQ ID NO: 3110 - RNA, 708 nt, synthetic construct
  misc_feature 1..708: note = derived and/or modified CDS sequence (wt) from TAHV(XJ0708)__HM243139.1__N
  source 1..708: mol_type = other RNA
atgtctgatttggttttttatgatgtcgcatccaccggtgcaaatggatttgatcctgatgcagggtatgtggacttctgtgctaaatatggggaagcaattaatctccattccgttaggatcttcttccttaatgccgcaaaagccaaggctgctctcgctcgtaagccagagaggaaggctagtcctaaatttggagagtggcaggtggaggttgtcaataatcattttcctggaaacaggaacaacccaattgataacaacgatcttaccatccaccggctgtcagggtatttggctagatgggtgctagagcagttcaaagaaaatgaggacgcagcccagcgggagttgatcaagacaacagtcatcaacccgatagctgaatccaatgggatcagatgggataatggagcagaaatctatttggcattcttcccgggaacagaaatgttcttggaaactttcaatttttacccgttgacaattggcatctacagagtcaagcaaggaatgatggatccccagtacttgaagaaggcattaaggcagcgctatgggcctcttactgcagacaaatggatgtcgcagaagaccgtcgccatagctaagagcctgaaggatgttgaacagctcaagtggggaagaggtggtctcagcgacactgcaagaacattcctgcagaaatttggaatcagacttccataa

SEQ ID NO: 3111 - RNA, 708 nt, synthetic construct
  misc_feature 1..708: note = derived and/or modified CDS sequence (wt) from TVTV(AR42)__KX891323.1__N
  source 1..708: mol_type = other RNA
atgtcagagcttgtcttttatgatgctccatcaacaggtgcaaacggatttgatcccgatgcagggtatgtggcatttattgctgcacatgccggatcgtacgatctttctgctgttaggatcttcttcctcaatgctgccaaggccaagaatgctctctcgagaaaaccagaggggaaggttagtattaaatttggcgagtggtcggtggaggtggtcaataatcattttcctggcaacaggaacaatccaattggtaacaacgatcttaccatccacagaatttcaggctatctcgcaagatgggttctagaagagttcaaaggacaagatgatgaggcccagaaggacatcattcgctcaaccattgtgaacccaattgcagagtccaatgggatccactgggatagcggtgcagatgcctacctatcatttttccctggcactgaaatgtttctggaatcatttgatttcctcccattagcaattgggatctatagagtcaaaaatggcatgatggatgtccaatacctgaagaaagctctccgtcagaggtacgggactatgacagcagacaagtggatgtctactaagacaacagtaattgcaaagaccctgaagagagttgagagcttcaaatggggtaagggaggactaagtgaggcagccagagcattcctctcaaaatttaatgtaaaaataccatga

SEQ ID NO: 3112 - RNA, 708 nt, synthetic construct
  misc_feature 1..708: note = derived and/or modified CDS sequence (wt) from TVTV(ND3374)__KM215564.1__N
  source 1..708: mol_type = other RNA
atgtcagagcttgtcttttatgatgctccatcaacaggtgcaaacggatttgatcccgatgcagggtatgtggcatttattgctgcacatgccggatcgtacgatctttctgctgttaggatcttcttcctcaatgctgccaaggccaagaatgctctctcgagaagaccagaggggaaggttagtattaaatttggcgagtggtcggtggaggtggtcaataatcattttcctggcaacaggaacaatccaattggtaacaacgatcttaccatccacagaatttcaggctatctcgcaagatgggttctagaagagttcaaaggacaagatgatgaggcccagaaggacatcatccgctcaaccattgtgaacccaattgcagagtccaatgggatccactgggatagcggtgcagatgcctacctgtcattctttcctggcactgaaatgtttctggagtcatttgatttcctcccattagcaattgggatctatagagtcaaaaatggcatgatggatgtccaatacctgaagaaagctctccgtcaaagatacgggactatgacagcagacaagtggatgtctactaagacaacagtaattgcaaagaccctgaagagagttgagagcttcaaatggggtaagggaggactaagtgaggcagccagagcattcctctcaaaatttaatgtaaaaataccatga

SEQ ID NO: 3113 - RNA, 708 nt, synthetic construct
  misc_feature 1..708: note = derived and/or modified CDS sequence (wt) from JCV(3324-04)__HM007356.1__N
  source 1..708: mol_type = other RNA
atgggagatctggttttttatgatgtcgcatccacaggtgcaaatggatttgatccagatgcagggtttgtggcatttatggctgaccatggggaatctgtcagtctgtcagccgttaggatcttcttccttaatgcagcaaaagccaaagctgctctcgctcgtaaaccggagcggaaagctactcctaaatttggagagtggcaggtggaaattgtcaataatcattttcctggaaacaggaacaacccaattggtaacaacgatcttaccatccatcggctttcaggatatctagccagatgggttcttgagcattttactacagatgatgatgagtcccagagagaactcataaggagcaccatcattaatccaattgcagagtccaatggcattcattggaacaatggcccagagatttatctttcattctttccaggaacagaaatgtttctggaaattttcaaattctatcccttgaccattggaatttacagagtcaagcatggtatgatggaccctcagtatctgaagaaggctctcagacagcgctatggcaccttgactgcagagaagtggatggcacagaagacagtgctcattgctaagagtctaaaggatgtagaacagcttaaatggggaagaggggggcttagcgatgctgcaagaaccttcttgatcaaatttggtgtgaaactgccttaa

SEQ ID NO: 3114 - RNA, 708 nt, synthetic construct
  misc_feature 1..708: note = derived and/or modified CDS sequence (wt) from JCV(61v2235)__U12796.1__N
  source 1..708: mol_type = other RNA
atgggagatttggttttctatgatgtcgcatccacaggtgcaaatggatttgatccagatgcagggtttgtggcatttatggctgaccacggagagtctatcaatctgtcagccgttaggatcttcttccttaatgcagcaaaagccaaagctgctctcgctcgtaaaccggagcggaaagctactcctaagtttggagagtggcaggtggagatcgtcaataatcatttttctggaaacaggaacaacccaattggtaacaacgatcttaccatccataggctttcaggatatctagccagatgggttcttgagcattttaactcagatgatgacgagtctcagagagaactcataaggagcaccatcataaatccaattgcagaatccaatggaattcattggaacaatggcccagaaatttatctttcgttcttcccagggaccgaaatgttcctagaaattttcaagttctacccgttaaccatcgggatttacagagtcaaacatggtatgatggatccccagtacttgaagaaggctctcaggcaacgctatggcaccttgactgcagagaagtggatggcgcagaagacagtgctcattgctaagagcttgaaggatgtcgagcagctcaaatggggaagaggaggacttagtgatgctgcaagaaccttcttgatcaaatttggtgtaaagttgccataa

SEQ ID NO: 3115 - RNA, 708 nt, synthetic construct
  misc_feature 1..708: note = derived and/or modified CDS sequence (wt) from JCV(1064-03)__EF681816.1__N
  source 1..708: mol_type = other RNA
atgggagatttggttttctatgatgtcgcatccacaggtgcaaatggatttgatccagatgcagggtttgtggcatttatggctgaccatggggaagctatcaatttggcagccgttaggatcttcttccttaatgcagcaaaagccaaagctgctctcgctcgtaaaccggagcggaaagctactcctaagtttggagagtggcaggtggagattgtcaataatcattttcctggaaacaggaacaacccaattggtaacaacgatcttaccatccatcggctttccggatatttagccagatgggttcttgaacatttcaccgaagatgatgacgagtctcagagagagctcataaggagcaccatcataaatccaattgcagaatccaatggcattcattggaacaatggcccagaaatttacctttcattcttcccagggacagaaatgtttctggaagtttttaaattctaccccttgaccattgggatttacagagtcaagcatggtatgatggatcctcagtacctaaagaaggccctcagacaacgctatggcaccttgactgcagagaagtggatggcacagaagacagtgctcattgctaagagtctaaaggatgttgagcagctcaaatggggaagaggagggctcagtgatgctgcaagaaccttcctgatcaaatttggtgtgaaactgccttaa

SEQ ID NO: 3116 - RNA, 708 nt, synthetic construct
  misc_feature 1..708: note = derived and/or modified CDS sequence (wt) from JCV(33909)__EF681853.1__N
  source 1..708: mol_type = other RNA
atgggagatttggttttctatgatgtcgcatccacaggtgcaaatggatttgatccagatgcagggtttgtggcatttatggctgaccacggggaagttatcaatctggcagccgttaggatcttcttccttaatgcagcaaaagccaaagctgctctcgctcgtaaaccggagcggaaagctactcctaagtttggagagtggcaggtggagattgtcaataatcattttcctgggaacaggaacaacccaattggtaacaacgatcttaccatccatcggctttccggatatctagccagatgggttcttgagcatttcaccgaagatgatgatgagtctcaaagagagttaataaggagcaccatcataaatccaattgcagaatccaatggcattcattggaacaatggaccagaaatttacctttcatttttcccagggacagaaatgttcttggaagttttcaaattttaccccttaaccatcgggatttacagagtcaaacatggtatgatggatcctcagtacttaaaaaaggctctcagacaacgctatggcaccttgactgcagagaagtggatggcacagaagacagtgctcattgccaagagtctaaaggatgttgaacaactcaaatggggaagaggagggcttagcgatgctgcaagaacattcttgatcaaattcggtgtaaaactgccttga

SEQ ID NO: 3117 - RNA, 708 nt, synthetic construct
  misc_feature 1..708: note = derived and/or modified CDS sequence (wt) from JCV(2179-00)__EF681808.1__N
  source 1..708: mol_type = other RNA
atgggagatctggttttttatgatgtcgcatccacaggtgcaaatggatttgatccagatgcagggtttgtggcatttatggctgaccatggggaatctgtcagtctgtcagccgttaggatcttcttccttaatgcagcaaaagccaaagctgctctcgctcgtaaaccggagcggaaagctactcctaaatttggagagtggcaggtggaaattgtcaataatcattttcctggaaacaggaacaacccaattggtaacaacgatcttaccatccatcggctttcaggatatctagccagatgggttcttgagcattttactacagatgatgatgagtcccagagagaactcataaggagcaccatcattaatccaattgcagagtccaatggcattcattggaacaatggcccagagatttatctttcattctttccaggaacagaaatgtttctggaaattttcaaattctatcccttgaccattggaatttacagagtcaagcatggtatgatggaccctcagtatctgaagaaggctctcagacagcgctatggcatcttgactgcagagaagtggatggcacagaagacagtgctcattgctaagagtctaaaggatgtagaacagcttaaatggggaagaggggggcttagcgatgctgcaagaaccttcttgatcaaatttggtgtgaaactgccttaa

SEQ ID NO: 3118 - RNA, 708 nt, synthetic construct
  misc_feature 1..708: note = derived and/or modified CDS sequence (wt) from JCV(2989-06)__EF681849.1__N
  source 1..708: mol_type = other RNA
atgggagatctgattttttatgatgtcgcatccacaggtgcaaatggatttgatccagatgcagggtttgtggcatttatggctgaccatggggaatctgtcagtctgtcagccgttaggatcttcttccttaatgcagcaaaagccaaagctgctctcgctcgtaaaccggagcggaaagctactcctaaatttggagagtggcaggtggaaattgtcaataatcattttcctggaaacaggaacaacccaattggtaacaacgatcttaccatccatcggctttcaggatatctagccagatgggttcttgagcattttactacagatgatgatgagtcccagagagaactcataaggagcaccatcattaatccaattgcagagtccaatggcattcattggaacaatggcccagagatttatctttcattctttccaggaacagaaatgtttctggaaattttcaaattctatcccttgaccattggaatttacagagtcaagcatggtatgatggaccctcagtatctgaagaaggctctcagacagcgctatggcaccttgactgcagagaagtggatggcacagaagacagtgctcattgctaagagtctaaaggatgtagaacagcttaaatggggaagaggagggcttagcgatgctgcaagaaccttcttgatcaaatttggtgtgaaactgccttaa

SEQ ID NO: 3119 - RNA, 708 nt, synthetic construct
  misc_feature 1..708: note = derived and/or modified CDS sequence (wt) from JCV(5592-02)__EF681804.1__N
  source 1..708: mol_type = other RNA
atgggagatctggttttttatgatgtcgcatccacaggtgcaaatggatttgatccagatgcagggtttgtggcatttatggctgaccatggggaatctgtcagtctgtcagccgttaggatcttcttccttaatgcagcaaaagccaaagctgctctcgctcgtaaaccggagcggaaagctactcctaaatttggagagtggcaggtggaaattgtcaataatcattttcctggaaacaggaacagcccaattggtaacaacgatcttaccatccatcggctttcaggatatctagccagatgggttcttgagcattttactacagatgatgatgagtcccagagagaactcataaggagcaccatcattaatccaattgcagagtccaatggcattcattggaacaatggcccagagatttatctttcattctttccaggaacagaaatgtttcttgaaattttcaaattctatcccttgaccattggaatttacagagtcaagcatggtatgatggaccctcagtatctgaagaaggctctcagacagcgctatggcaccttgactgcagagaagtggatggcacagaagacagtgctcattgctaagagtctaaaggatgtagaacagcttaaatggggaagaggggggcttagcgatgctgcaagaaccttcttgatcaaatttggtgtgaaactgccttaa

SEQ ID NO: 3120 - RNA, 708 nt, synthetic construct
  misc_feature 1..708: note = derived and/or modified CDS sequence (wt) from JCV(F5609)__KM215546.1__N
  source 1..708: mol_type = other RNA
atgggagatttggttttttatgatgtcgcatccacaggtgcaaatggatttgatccagatgcagggtttgtggcatttatggctgaccatggggaatctgtcagtctgtcagccgttaggatcttcttccttaatgcagcaaaagccaaagctgctctcgctcgtaaaccggagcggaaagctactcctaaatttggagagtggcaggtggaaattgtcaataatcattttcctggaaacaggaacaacccaattggtaacaacgatctcaccatccatcggctttcaggatatctagccagatgggttcttgagcatttcaccacagatgatgatgagtcccaaagagaactcataaggagcaccatcataaatccaattgcagagtccaatggtattcattggaacaatggcccagagatttatctttcatttttcccagggacagaaatgtttctggaaattttcaaattctatcccttgaccattggaatttacagagttaagcatggtatgatggacccgcagtatctgaagaaggctctcagacagcgctatggcactttgactgcagagaagtggatggcacagaagacagtgctcattgctaagagtctaaaggatgtagaacagcttaaatggggaagaggaggactcagcgatgctgcaagaaccttcttgaccaaatttggtgtgaaattgccttaa

SEQ ID NO: 3121 - RNA, 708 nt, synthetic construct
  misc_feature 1..708: note = derived and/or modified CDS sequence (wt) from JCV(F6577)__KM215557.1__N
  source 1..708: mol_type = other RNA
atgggagatttggttttttatgatgtcgcatccacaggtgcaaatggatttgatccagatgcagggtttgtggcatttatggctgaccatggggaatctgtcagtctgtcagccgttaggatcttcttccttaatgcagcaaaagccaaagctgctctctctcgtaaaccggagcggaaagctactcctaaatttggagagtggcaggtggaaattgtcaataatcattttcctggaaacaggaacaacccaattggtaacaacgatcttaccatccatcggctttcaggatatctagccagatgggttcttgagcatttcaccacagatgatgatgagtctcaaagagaactcataaggagcaccatcataaatccaattgcagagtccaatggcattcattggaacaatggcccagagatttatctttcattcttcccaggaacagaaatgtttctggaaattttcaaattctatcccttgaccattggaatttacagagtcaagcatggtatgatggacccgcagtatctgaagaaggctctcagacagcgctatggcaccttgactgcagagaagtggatggcacagaagacagtgctcattgctaagagtctaaaggatgtagaacagcttaaatggggaagaggaggccttagcgatgctgcaagaaccttcttgatcaaatttggtgtgaaattgccttaa

SEQ ID NO: 3122 - RNA, 708 nt, synthetic construct
  misc_feature 1..708: note = derived and/or modified CDS sequence (wt) from JCV(W13135)__KM215552.1__N
  source 1..708: mol_type = other RNA
atgggagatttggttttttatgatgtcgcatccacaggtgcaaatggatttgatccagatgcagggtttgtggcatttatggctgaccatggggaatctgtcaatctgtcagccgttaggatcttcttccttaatgcagcaaaagccaaagctgctctcgctcgtaaaccggagcggaaagctactcctaaatttggagagtggcaggtggaaattgtcaataatcattttcctggaaacaggaacaacccaattggtaacaacgatctcaccatccatcggctttcaggatatctagccagatgggttcttgagcatttcaccacagatgatgatgagtcccaaagagaactcataaggagcaccatcataaatccaattgcagagtccaatggcattcattggaacaatggcccagagatttatctttcattcttcccagggacagaaatgtttctggaaattttcaaattctatcccttgaccattggtatttacagagtcaagcatggtatgatggacccgcagtatctgaagaaggctctcagacagcgctatggcactttgactgcagagaagtggatggcacagaagacagtgctcattgctaagagtctaaaggatgtagaacagcttaaatggggaagaggaggacttagcgatgctgcaagaaccttcttgatcaaatttggtgtgaaattgccttaa

SEQ ID NO: 3123 - RNA, 708 nt, synthetic construct
  misc_feature 1..708: note = derived and/or modified CDS sequence (wt) from JCV(W18393)__KM215559.1__N
  source 1..708: mol_type = other RNA
atgggagatttggttttctatgatgtcgcatccacaggtgcaaatggatttgatccagatgcagggtttgtggcatttatggctgaccacggagagtctatcaatctgtcagccgttaggatcttcttccttaatgcagcaaaagccaaagctgctctcgctcgtaaaccggagcggaaagctactcctaagtttggagagtggcaggtggagatcatcaataatcattttcctgggaacaggaacaacccaattggtaacaacgatcttaccatccataggctttcaggatatttagccagatgggttcttgagcatttcaccgcagatgacgatgaatctcaaagagaactcataagaagcaccatcataaatccaatcgcagaatccaatgggatccattggaacaatggtccagaaatttatctttcatttttcccaggaaccgaaatgttcctagaaatcttcaagttctacccgttaaccattggaatttacagagtcaaacatggtatgatggatccccagtatctgaagaaggccctcaggcaacgctatggcaccttgactgcagagaaatggatggcacagaagacagtgctcattgctaagagcttgaaggatgttgagcagctcaaatggggaagaggaggtcttagtgatgctgcaagaactttcctgatcaaatttggtgtaaaactgccataa

SEQ ID NO: 3124 - RNA, 708 nt, synthetic construct
  misc_feature 1..708: note = derived and/or modified CDS sequence (wt) from KEYV(KEYV/Ochlerotatus atlanticus/USA/KEYVLK01/2005)__KT630290.1__N
  source 1..708: mol_type = other RNA
atgggtgatttggttttctatgatgtcgcatccacaggtgcaaatggatttgatcctgatgcagggtatgtggcatttatggctaaccatggggagtcgatcagtctgtcaaccgttaggatcttcttccttaatgccgcaaaggccaaagctgctctcactcgtaagccggagcggaaggctacacctaagtttggagagtggcaggtggagatcgtcaataatcattttcctggaaacaggaacaacccaattggtaacaacgatcttaccttgcaccggatttcaggatatctagctagatgggtgctggagcactttggagagggtgaggacgagtcacaaaaggagctgatcaagagcactgtcatcaatccaattgccgagtccaatgggattcgctggggcaacggtgtagaaatctatctctccttcttcccaggaactgaaatgtttctggaattgttcaaattctacccattgacaattggcatctacagagtgaaacatggaatgatggatgctcagtacctaaaaaaagctctgagacagcgctatgggacattgactgcagacaaatggatggctcaaaagacatctatgattacaaagagcctcaaagatgtagagcagctcaagtggggaaagggtggtctcagcgatactgccagagcttttcttgctaaattcggtgtgagacttccatga

SEQ ID NO: 3125 - RNA, 708 nt, synthetic construct
  misc_feature 1..708: note = derived and/or modified CDS sequence (wt) from KEYV(KEYV/Ochlerotatus atlanticus/USA/KEYVLK02/2005)__KT630293.1__N
  source 1..708: mol_type = other RNA
atgggtgatttggttttctatgatgtcgcatccacaggtgcaaatggatttgatcctgatgcagggtatgtggcatttatggctaaccatggggagtcgatcagtctgtcaaccgttaggatcttcttccttaatgccgcaaaagccaaagctgctctcactcgtaagtcggagcggaaggctacacctaagtttggagagtggcaggtggagatcgtcaataatcattttcctggaaacaggaacaacccaattggtaacaacgatcttaccttgcaccggatttcgggatatctagctagatgggtgctggagcactttggagagggtgaggacgagtcacaaaaggagctgatcaagagcactgtcatcaatccaattgccgagtccaatgggattcgctggggcaatggtgtagaaatctatctctccttcttcccaggaactgaaatgtttctggaattgttcaaattctacccattgacaattggcatctacagagtgaaacatggaatgatggatgctcagtacctaaaaaaagctctgagacagcgctacgggacattgactgcagataaatggatggctcaaaagacatctatgattacaaagagcctcaaagatgtggagcagcttaagtggggaaagggtggcctcagcgatactgccagagctttccttgctaaattcggcgtgagacttccatga

SEQ ID NO: 3126 - RNA, 708 nt, synthetic construct
  misc_feature 1..708: note = derived and/or modified CDS sequence (wt) from KEYV(C14031-33)__U12801.1__N
  source 1..708: mol_type = other RNA
atgggtgatttggttttctatgatgtcgcatccacaggtgcaaatggatttgatcctgatgcagggtatgtggcatttatggctaaccatggggagtcgatcagtctgtcaaccgttaggatcttcttccttaatgccgcaaaagccaaagctgctctcactcgtaagccggagcggaaggctacacctaagtttggagagtggcaggtggagatcgtcaataatcattttcctggaaacaggaacaacccaattggtaacaacgatcttaccttgcaccggatttcaggatatctagctagatgggtgctggagcactttggagagggtgaggacgagtcacaaaaggagctgatcaagagcactgtcatcaatccaattgccgagtccaacgggattcgctggggcaacggtgtagaaatctatctctccttcttcccaggaactgaaatgtttctggaattgttcaaattctacccattgacaattggcatctacagagtgaaacatggaatgatggatgctcagtacctaaaaaaagctctgagacagcgctatgggacattgactgcagataaatggatggctcaaaagacatctatgattacaaagagcctcaaagatgtggagcagctaaagtggggaaagggtggtctcagcgatactgccagagctttccttgctaaattcggcgtgagacttccatga

SEQ ID NO: 3127 - RNA, 708 nt, synthetic construct
  misc_feature 1..708: note = derived and/or modified CDS sequence (wt) from LACV(Human/78)__NC_004110.1__N
  source 1..708: mol_type = other RNA
atgtcggatttggtgttttatgatgtcgcatcaacaggtgcaaatggatttgatcctgatgcagggtatatggacttctgtgttaaaaatgcagaattactcaaccttgctgcagttaggatcttcttcctcaatgccgcaaaggccaaggctgctctctcgcgtaagccagagaggaaggctaaccctaaatttggagagtggcaggtggaggttatcaataatcattttcctggaaacaggaacaacccaattggtaacaacgatcttaccatccacagattatctgggtatttagccagatgggtccttgatcagtataacgagaatgatgatgagtctcagcacgagttgatcagaacaactattatcaacccaattgctgagtctaatggtgtaggatgggacagtgggccagagatctatctatcattctttccaggaacagaaatgtttttggaaactttcaaattctacccgctgaccattggaattcacagagtcaagcaaggcatgatggaccctcaatacctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcagaaatttggcatcaggcttccataa

SEQ ID NO: 3128 - RNA, 708 nt, synthetic construct
  misc_feature 1..708: note = derived and/or modified CDS sequence (wt) from LACV__KP271107.1__N
  source 1..708: mol_type = other RNA
atgtcggatttggtgttttatgatgtcgcatcaacaggtgcaaatggatttgatcctgatacagggtatatggacttctgtgttaaaaatgcagaatcactcaaccttgctgcagttaggatcttcttcctcaatgccgcaaaggccaaggctgctctctcgcgtaagccagagaggaaggctaaccctaaatttggagagtggcaggtggaggttatcaataatcattttcctggaaacaggaacaacccaattggtaacaacgatcttaccatccacagattatctgggtatttagccaggtgggtccttgatcagtataacgagaatgatgatgagtctcagcacgagttgatcaggacaactattatcaacccaattgctgagtctaatggtgtgggatgggacagtgggccagagatctatctatcattttttccaggaacagaaatgtttttggaaactttcaaattctacccgctgaccattggaattcacagagtcaagcaaggcatgatggaccctcagtatctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcagaaatttggcatcaggcttccataa

SEQ ID NO: 3129 - RNA, 708 nt, synthetic construct
  misc_feature 1..708: note = derived and/or modified CDS sequence (wt) from LACV(BEN2_Lafayette_WI_2007)__GU596386.1__N
  source 1..708: mol_type = other RNA
atgtcggatttggtgttttatgatgtcgcatcaacaggtgcaaatggatttgatcctgatgcagggtatatggacttctgtgttaaaaatgcagaatcactcaaccttgctgcagttaggatcttcttcctcaatgccgcaaaggccaaggctgctctctcgcgtaagccagagaggaaggctaaccctaaatttggagagtggcaggtggaggttatcaataatcattttcctggaaacaggaacaacccaattggtaacaacgatcttaccatccacagattatctgggtatttagccagatgggtccttgatcagtataacgagaatgatgatgagtctcagcacgagttgatcagaacaactattatcaacccaattgctgagtctaatggtgtgggatgggacagtgggccagagatctatctatcattctttccaggaacagaaatgtttttggaaactttcaaattctacccgctgaccattggaattcacagagtcaagcaaggcatgatggaccctcaatacctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcaaaaatttggcatcaggcttccataa

SEQ ID NO: 3130 - RNA, 708 nt, synthetic construct
  misc_feature 1..708: note = derived and/or modified CDS sequence (wt) from LACV(Dallas/TX/2009)__GU591164.1__N
  source 1..708: mol_type = other RNA
atgtcggatttggtgttttatgatgtcgcatcaacaggtgcaaatggatttgatcctgatgcagggtatatggacttctgtgttaaaaatgcagagtcactcaaccttgctgcagttaggatcttcttcctcaatgccgcaaaggccaaggctgctctctcgcgtaagccagagaggaaggctaaccctaaatttggagagtggcaggtggaggttgtcaataatcattttcctggaaacaggaacaatccaattggtaacaacgatcttaccatccacagattatctgggtatttagccagatgggtccttgaccagtataatgagaatgatgacgaatctcagcgtgaattgatcagaacaactattatcaatccaattgctgagtccaatggtgtgaggtgggacagtgggccagagatctatctatcgtttttcccaggaacagagatgtttttggaaacctttaaattctacccgctaaccatcggcattcacagagtcaagcagggcatgatggaccctcaatatctgaaaaaggccttaaggcaacgctatggcaccctcacagcagacaaatggatgtcacagaaggttgctgcaattgctaagagcctgaaggatgtagagcagcttaaatggggaaaaggaggcctgagtgatactgctaaaacattcctgcagaaatttggcatcaggcttccataa

SEQ ID NO: 3131 - RNA, 708 nt, synthetic construct
  misc_feature 1..708: note = derived and/or modified CDS sequence (wt) from LACV(Fort Bend County/TX/2009)__GU591167.1__N
  source 1..708: mol_type = other RNA
atgtcggatttggtgttttatgatgtcgcatcaacaggtgcaaatggatttgatcctgatgcagggtatatggacttctgtgttaaaaatgcagaatcactcaaccttgctgcagttaggatcttcttcctcaatgccgcaaaggccaaggctgctctctcgcgtaagccagagaggaaggctaaccctaaatttggagagtggcaggtggaggttatcaataatcattttcctggaaacaggaacaatccaattggtaacaacgatcttaccatccacagattatctgggtatttagccagatgggtccttgaccagtataatgagaatgatgacgaatctcagcgtgaattgatcagaacaactattatcaatccaattgctgagtccaacggtgtgaggtgggacagtgggccagagatctatctatcgtttttcccaggaacagagatgtttttggaaacctttaaattctacccgctaaccatcggcattcacagagtcaagcagggcatgatggaccctcaatatctgaaaaaggccttaaggcaacgctatggcaccctcacagcagacaaatggatgtcacagaaggttgctgcaattgctaagagcctgaaggatgtagagcagcttaaatggggaaaaggaggcctgagcgatactgctaaaacattcttgcagaaatttggcatcaggcttccataa

SEQ ID NO: 3132 - RNA, 708 nt, synthetic construct
  misc_feature 1..708: note = derived and/or modified CDS sequence (wt) from LACV(LACV/95/OH-H (CCH-MB96))__GU206135.1__N
  source 1..708: mol_type = other RNA
atgtcggatttggtgttttatgatgtcgcatcaacaggtgcaaatggatttgatcctgatgcagggtatatggacttctgtgttaaaaatgcagaatcactcaaccttgctgcagttaggatcttcttcctcaatgccgcaaaggccaaggctgctctctcgcgtaagccagagaggaaggctaaccctaaatttggagagtggcaggtggaggttgtcaataatcattttcctggaaacaggaacaacccaattggtaacaacgatcttaccatccacagattgtctgggtatttagccagatgggttcttgatcagtataacgaaaatgatgacgagtctcagcacgagttgattaaaacaactattatcaacccaattgctgagtctaatggtgtgggatgggatagtgggccagagatctatctatcattcttcccaggaacagaaatgtttttggaaactttcaagttctacccgctgaccattggaattcacagagtcaagcaaggcatgatggaccctcagtacctaaagaaggccttaaggcaacgctatggcactctcacagcagataagtggatgtcacagaaggttgcagcaattgctaagagcttgaaggatgtagagcagcttaaatggggaaaaggaggcctgagtgatactgctaaaacattcctgcagaaatttggcatcaggcttccataa

SEQ ID NO: 3133 - RNA, 696 nt, synthetic construct
  misc_feature 1..696: note = derived and/or modified CDS sequence (wt) from OROV(BeAn19991)__NC_005777.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagcgcgctgggcctttacccagatgcgatcaccaattaagcaagctgagttcagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcagaggtatggtcaaaagactgccgagcaatggatgcgtgaagaaatagttgctgtaagagcagcttttgaagctgtaggcactctggcctgggccagaactggattctccccagcagcaagagacttcttgcgccaattcggaattgacatatag

SEQ ID NO: 3134 - RNA, 696 nt, synthetic construct
  misc_feature 1..696: note = derived and/or modified CDS sequence (wt) from OROV(AR136921)__HQ830443.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccaatcgaatccagtgccggacaacggtcttaccttgcaccgtctgtcaggatacctagcgcgctgggcctttacccagatgcgatcaccaattaagcaagctgagttcagagccactgtagtagtgcctttggctgaggtaaagggctgtacttggaatgatggtgacgcaatgtacctggggtttgctgctggtgctgagatgttcctgcaaactttcactttcttccctttggtgattgagatgcatagggttctcaaggatggcatggatgtcaactttatgaagaaagtcctccggcaacgctatggccaaaagactgccgagcaatggatgcgtgaagaaatagttgctgtaagagcagcttttgaagctgtaggcactctggcctgggccagaactggattctccccagcagcaagagacttcttgcgccaattcggaattggcatatag

SEQ ID NO: 3135 - RNA, 696 nt, synthetic construct
  misc_feature 1..696: note = derived and/or modified CDS sequence (wt) from OROV(AR366927)__HQ830448.1__N
  source 1..696: mol_type = other RNA
atgtcagagttctttttcaatgatgtaccacaacggactacatctacatttgatccggaggcagcatatgtggcatttgaagctagatacggacaagtgctcaatgctggtgttgttagagtcttcttccttaaccaaaagaaggccaaagatgtcttacgtaagacatccaggcccatggttgaccttacttttggtggggtccaatttgcaatggttaataaccatttcccacaattccagtccaatccagtgccggacaacggtcttaccttgcaccgtctgtcgggatacctagctcgctgggcctttacccagatgcggtcaccaattaaacaagctgagtttagggccactgtggtagtgcctttggcagaggtgaagggctgtacttggaatgatggtgatgcaatgtatctggggtttgctgccggtgctgagatgtttctgcagacattcactttcttccctttggtgattgagatgcacagggtcctcaaggacggcatggatgtgaactttatgaagaaagtacttcggcaaaagtatggccaaaagactgctgaacaatggatgcgtgaagaaatagttgctgtaagagcagcttttgaggctgtaggcactctggcctgggccaggactggattctccccagcagcaagggacttcttgcgccaattcggaattggcatatag

SEQ ID NO: 3136 - RNA, 696 nt, synthetic construct
  misc_feature 1..696: note = derived and/or modified CDS sequence (wt) from OROV(BeAn 206119)__AY993909.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagcgcgctgggcctttacccagatgcgatcaccaattaagcaagctgagttcagagccgctgtagtagtgcctttggttgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaagactgccgagcagtggatgcgtgaagaaatagttgctgtaagagcagcttttgaaactgtaggcactttcgcctgggccagaactggattctccccagcagcaagagacttcttgcgccaattcggaattggcatatag

SEQ ID NO: 3137 - RNA, 696 nt, synthetic construct
  misc_feature 1..696: note = derived and/or modified CDS sequence (wt) from OROV(BeAn 208819)__AY993911.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagcgcgctgggcctttacccagatgcgatcaccaattaagcaagctgagttcagagccactgtagtagtgcctttggttgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaagactgccgagcagtggatgcgtgaagaaatagttgctgtaagagcagcttttgaagctgtaggcactctggcctgggccagaactggattctccccagcagcaagagacttcttgcgccaattcggaattggcatatag

SEQ ID NO: 3138 - RNA, 696 nt, synthetic construct
  misc_feature 1..696: note = derived and/or modified CDS sequence (wt) from OROV(BeAn 208823)__AY993912.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagcgcgctgggcctttacccagatgcgatcaccaattaagcaagctgagttcagagccactgtagtagtgcctttggttgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaagactgccgagcggtggatgcgtgaagaaatagttgctgtaagagcagcttttgaagctgtaggcactctggcctgggccagaactggattctccccagcagcaagagacttcttgcgccaattcggaattggcatatag

SEQ ID NO: 3139 - RNA, 696 nt, synthetic construct
  misc_feature 1..696: note = derived and/or modified CDS sequence (wt) from OROV(H244576)__HQ830444.1__N
  source 1..696: mol_type = other RNA
atgtcagagttctttttcaatgatgtaccacaacggactacatctacatttgatccggaggcagcatatgtggcatttgaagctagatacggacaagtcctcaatgctggtgttgttagagtcttcttccttaaccaaaagaaggccaaagatgtcttacgtaagacatccaggcccatggttgaccttacttttggtggggtccaatttgcaatggttaataaccatttcccacaattccagtcgaatccagtgccggacaacggtcttaccttccaccgcctgtcgggatacctagctcgctgggcctttacccagatgcggtcaccaattaaacaagctgagtttagggccactgtggtagtgcctttggcagaggtgaagggctgtacttggaatgatggtgatgcaatgtatctggggtttgctgccggtgctgagatgtttctgcagacattcactttcttccctttggtgattgagatgcacagagtcctcaaggacggcatggatgtgaactttatgaagaaagtccttcggcaaaagtatggccaaaagactgctgaacaatggatgcgtgaagaaatagttgctgtaagagcagcttttgaggccgtaggcactctggcctgggccaggactggattctccccagcagcaagagacttcttgcgccaattcggaattggcatatag

SEQ ID NO: 3140 - RNA, 696 nt, synthetic construct
  misc_feature 1..696: note = derived and/or modified CDS sequence (wt) from OROV(H355186)__HQ830446.1__N
  source 1..696: mol_type = other RNA
atgtcagagttcattttcagcgatgtaccacaacggactacatctacatttgatccggaggcagcatatgtggcatttgaagctagatacggacaagtgctcaatgctggtgttgttagagtcttcttccttaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcgatcaccaattaagcaagctgagtttagagccactgtagtagtgcctttggctgaggtaaagggctgtacttggaatgatggtgacgcaatgtacctggggtttgctgctggtgctgagatgttcctgcagacattcactttcttccctttggtgattgagatgcatagggttctcaaggatggcatggatgtcaactttatgaagaaagtcctccggcaacgatatggccaaaaaactgccgagcaatggatgcgtgaagaaatagttgctgtaagagcagcttttgaagctgtaggcactctggcctgggccagaactggattctccccagcagcaagagacttcttgcgccaattcggaattggcatatag

SEQ ID NO: 3141 - RNA, 696 nt, synthetic construct
  misc_feature 1..696: note = derived and/or modified CDS sequence (wt) from OROV(H356898)__HQ830447.1__N
  source 1..696: mol_type = other RNA
atgtcagagttcattttcaacgatgtaccacaacggactacatctacatttgatccggaggccgcatatgtgtcatttgaagctagatacggacaagtgctcaatgctggtgtcgttagagtcttcttccttaaccaaaagaaggccaaggatgtcttacggaagacatcgaggcccatggttgaccttacttttggtggggtccaatttgcaatggttaataaccatttcccacagttccagtccaatccagtcccggacaacggtcttaccctgcaccgtctgtcaggatacctagctcgctgggcctttacccagatgcggtccccaattaagcaagctgagtttagagccactgtagtagtgcctttagctgaggtaaagggctgtacttggaatgatggtgacgcaatgtacctagggtttgctgctggtgctgagatgttcctgcaaacattcactttcttccctttggtgattgagatgcatagggttctcaaagatggcatggatgtcaactttatgaagaaagtcctccggcaacgatatggccaaaaaactgccgagcaatggatgcgcgaagaaatcgttgctgtaagggcagcttttgaagctgtaggcactctggcctgggccagaactggattctccccagcagcaagagacttcttacgccaattcggaattggcatatag

SEQ ID NO: 3142 - RNA, 696 nt, synthetic construct
  misc_feature 1..696: note = derived and/or modified CDS sequence (wt) from OROV(H389865)__HQ830453.1__N
  source 1..696: mol_type = other RNA
atgtcagagttcattttcaacgatgtaccacaacggactacatctacatttgatccggaggcagcatatgtggcatttgaagctagatacggacaagtcctcaatgctggtgttgttagagtcttcttcctcaaccaaaagaaggccaaggatgtcttacgaaagacatcgaggcccatggttgaccttacttttggtggggtgcaatttgcaatggttaataaccatttcccacaattccagtcgaatccagtgccggacaacggtcttaccctacaccgtctgtccggttacctagctcgctgggcatttacccacatgaggtcaccaattaaacaagctgagtttagggccactgttgtagtgcctttggcggaggtcaagggctgtacttggaatgatggtgatgcaatgtacctgggttttgctgcaggtgctgagatgtttctccaaacattcactttcttccctttggtgattgagatgcacagggtcctcaaggacggaatggatgtcaactttatgaagaaattcctccggcagcgctatggacaaaagactgccgagcaatggatgcgtgaagaaatactagctgtaaaagcagcttttgaatctgtaggcactctggcctgggccaggactggcttctccccagcagcaagagacttcttgcgccaattcgcaattggcatatag

SEQ ID NO: 3143 - RNA, 696 nt, synthetic construct
  misc_feature 1..696: note = derived and/or modified CDS sequence (wt) from OROV(H472433)__HQ830455.1__N
  source 1..696: mol_type = other RNA
atgtcagagttcattttcaacgatgtaccacaacggactacatctacatttgatccggaggcagcatatgtggcatttgaagctcgatacggacaagtgctcaatgctggtgttgttagagtcttcttccttaaccaaaagaaggccaaagatgtcttacgtaagacatcgaggcccatggttgaccttacttttagtggggtccaatttgcaatggttaataaccatttcccacagttccagtcgaatccagtgccggacaacggtcttaccttgcaccgtctgtcgggatacctagctcgctgggcatttacccagatgcgatcaccaattaagcaagctgagttcagggccactgtggtagtgcctttggcagaggtgaagggctgtacttggaacgacggtgacgcaatgtatctcggatttgctgctggtgctgaaatgtttctgcagacattcactttcttccctttggtgattgagatgcacagggtcctcaaggacggtatggatgtgaactttatgaagaaagttctacggcagaggtacggtcagaaaactgctgagcaatggatgcgtgaagagatagttgctgtaagagcagcctttgaggctgtaggcactctggcctgggccaggactgggttctctccagcagcaagagacttcttgcgccaattcggaattggcatatag

SEQ ID NO: 3144 - RNA, 696 nt, synthetic construct
  misc_feature 1..696: note = derived and/or modified CDS sequence (wt) from OROV(H532490)__HQ830463.1__N
  source 1..696: mol_type = other RNA
atgtcagagttcattttcaacgatgtaccacaacggactacatctacatttgatccggaggccgcatatgtgtcatttgaagctagatacggacaagtgctcaatgctggtgtcgttagagtcttcttccttaaccaaaagaaggccaaggatgtcttacgtaagacatcgagccccatggttgacctcacttttggtggggtccaatttgcaatggttaataaccatttcccacagttccagtcgaatccagtcccggacaacggtcttaccctgcaccgtctgtcaggatacctagctcgctgggcctttacccagatgcggtctccaattaaacaagctgagtttagggccactgtagtagtgcctttggctgaggtaaagggctgtacttggaatgatggtgacgcaatgtacctagggtttgctgctggtgctgagatgttcctgcaaacattcactttcttccctttggtgattgagatgcatagggttctaaaagatggcatggatgttaactttatgaagaaagtcctccggcaacgatatggccaaaaaactgccgagcaatggatgcgcgaagaaatagtcgctgtaagagcagcttttgaagctgtaggcactctggcctgggccagaactggattctccccagcagcaagagacttcttgcgccaattcggaattggcatatag

SEQ ID NO: 3145 - RNA, 696 nt, synthetic construct
  misc_feature 1..696: note = derived and/or modified CDS sequence (wt) from OROV(H543629)__HQ830467.1__N
  source 1..696: mol_type = other RNA
atgtcagagttccttttcaacgatgtaccacaacggactacatctacatttgatccggaggcagcatatgtggcatttgaagctagatacggacaagtgctcaatgctggtgttgttagagtcttcttcctcaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcggtcaccaattaagcaagctgagttcagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaagactgccgagcaatggatgcgtgaagaaatagttgctgtaagagcagcttttgaagctgtaggcactctggcctgggccagaactggattctccccagcaggaagagacttcttgcgccaattcggaattggcatatag

SEQ ID NO: 3146 - RNA, 696 nt, synthetic construct
  misc_feature 1..696: note = derived and/or modified CDS sequence (wt) from OROV(H543638)__HQ830468.1__N
  source 1..696: mol_type = other RNA
atgtcagagttccttttcaacgatgtaccacaacggactacatctacatttgatccggaggcagcatatgtggcatttgaagctagatacggacaagtgctcaatgctggtgttgttagagtcttcttcctcaaccaaaagaaggccaagaatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcggtcaccaattaagcaagctgagttcagagccactgtagtagtgcctttggctgaggtaaagggctgtacttggaatgatggtgatgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgccgagcaatggatgcgtgaagaaatagttgctgtaagagcagcttttgaagctgtaggcactctggcctgggccagaactggattctccccagcaggaagagacttcttgcgccaattcggaattggcatatag

SEQ ID NO: 3147 - RNA, 696 nt, synthetic construct
  misc_feature 1..696: note = derived and/or modified CDS sequence (wt) from OROV(H706890)__HQ830473.1__N
  source 1..696: mol_type = other RNA
atggcagaattcattttcaatgatgtaccacaacgcactacatctacatttgatccggaggcagcatatgtggcatttgaagctagatacggacaagtgctcaatgctggtgttgtcagagtcttcttcctcaaccaaaagaaggccaaagatgtcttacgtaagacatcgaggcccatggttgaccttacttttggtggggtccaatttgcaatggttaataaccatttcccacaattccagtccaatccagtgccggacaacggtcttaccttgcaccgtctgtcgggatacctagctcgctgggcctttacccagatgcggtcaccaattaagcaagctgagtttagggccactgtggttgtgcctttggcagaggtgaagggatgtacttggaatgatggtgatgcaatgtatctggggtttgctgccggtgctgagatgtttctgcaaacattcactttcttccctttggtgattgagatgcacagggtcctcaaggacggcatggatgtcaactttatgaagaaagtcctacggcagaggtatggccaaaaaactgccgagcaatggatgcgtgaagaaatagttgctgtaagagcagcttttgaggctgtagggactctggcctgggccaggactggattctccccagcagcaagagacttcttgcgccaattcggaattggcatatag

SEQ ID NO: 3148 - RNA, 696 nt, synthetic construct
  misc_feature 1..696: note = derived and/or modified CDS sequence (wt) from OROV(H758669)__HQ830479.1__N
  source 1..696: mol_type = other RNA
atgtcagagttcattttcaatgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatacttaataaccatttcccacagttccagtcgaatccagtgccggacaacggtcttaccttgcaccgtctgtcgggatacttagctcgctgggcctttacccagatgcggtcaccaattaagcaagctgagtttagggccactgtggtagtgcctttggcagaggtaaagggctgtacttggaatgatggtgacgcgatgtatctggggtttgctgctggtgctgagatgtttctgcagacattcactttctttcctttggtaattgagatgcacagggtcctcaaggacggcatggatgtcaactttatgaagaaagtccttcggcagaggtatggccagaagactgctgagcaatggatgcgtgaagaaatagttgctgtaagagcagcttttgaggctgtaggcactctggcctgggccaggactggattctccccagccgcaagagacttcttgcgccaattcggaattggcatatag

SEQ ID NO: 3149 - RNA, 696 nt, synthetic construct
  misc_feature 1..696: note = derived and/or modified CDS sequence (wt) from OROV(H758687)__HQ830478.1__N
  source 1..696: mol_type = other RNA
atgtcagagttcattttcaatgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccttgcaccgtctgtcgggatacttagctcgctgggcctttacccagatgcggtcaccaattaagcaagctgagtttagggccactgtggtagtgcctttggcagaggtaaagggctgtacttggaatgatggtgacgcgatgtatctggggtttgctgctggtgctgagatgtttctgcagacattcactttctttccttttgtaattgagatgcacagggtcctcaaggacggcatggatgtcaactttatgaagaaagtccttcggcagaggtatggccagaagactgctgagcaatggatgcgtgaagaaatagttgctgtaagagcagcttttgaggctgtaggcactctggcctgggccaggactggattctccccagcagcaagagacttcttgcgccaattcggaattggcatatag

SEQ ID NO: 3150 - RNA, 696 nt, synthetic construct
  misc_feature 1..696: note = derived and/or modified CDS sequence (wt) from OROV(H759041)__HQ830488.1__N
  source 1..696: mol_type = other RNA
atgtcagagttcattttcaatgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccttgcaccgtctgtcgggatacttagctcgctgggcctttacccagatgcggtcaccaattaagcaagctgagtttagggccactgtggtagtgcctttggcagaggtaaagggctgtacttggaatgatggtgacgcgatgtatctggggtttgctgctggtgctgagatgtttctgcagacattcactttctttcctttggtaattgagatgcacagggtcctcaacgacggcatggatgtcaactttatgaagaaagtccttcggcagaggtatggccagaagactgctgagcaatggatgcgtgaagaaatagttgctgtaagagcagcttttgaggctgtaggcactctggcctgggccaggactggattctccccagccgcaagagacttcttgcgccaattcggaattggcatatag

SEQ ID NO: 3151 - RNA, 696 nt, synthetic construct
  misc_feature 1..696: note = derived and/or modified CDS sequence (wt) from OROV(BeAr473358)__AF164539.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccatatgcgatcaccaattaagcaagctgagtttagagccactgtagtagtgcctttggctgaagtaaagggctgtacttggaatgatggtgacgcaatgtacctggggtttgctgctggtgctgaaatgttcctgcaaacattcactttcttccctttggtgattgagatgcatagggttctcaaggatggcatggatgtcaactttatgaaaaaaatcctccggcaacgatatggccaaaaaactgccgagcaatggatgcgtgaagaaataattgctgtaaaaacagcttttgaaactgtaggcactctggcctgggccataactggattctccccagcagcaagaaacttcttgcgccaattcgaaattgacatatag

SEQ ID NO: 3152 - RNA, 696 nt, synthetic construct
  misc_feature 1..696: note = derived and/or modified CDS sequence (wt) from OROV(BeH 521086)__AY704559.1__N
  source 1..696: mol_type = other RNA
atgtcagagttccttttcaacgatgtaccacaacggactacatctacatttgatccggaggcagcatatgtggcatttgaatctagatacggacaagtgctcaatgctggtgttgttagagtcttcttccttaaccaaaagaaggccaaggatgtcttacgtaagacatcgaggcccatggttgaccttacttttggtggggtccaatttacaatggttaataaccatttcccacagttccagtcgaatccagtgccggacaacggtcttaccctgcaccgtctgtcaggatacctagctcgctgggcctttacccagatgcgatcaccaattaagcaagctgagtttagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgccgagcaatggatgcgtgaagaaatagttgctgtaagagcagcttttgaagctgtaggcactctggcctgggccagaactggattctccccagcagcaagagacttcttgcgccaatccggaattggcatatag

SEQ ID NO: 3153 - RNA, 696 nt, synthetic construct
  misc_feature 1..696: note = derived and/or modified CDS sequence (wt) from OROV(BeH121923)__HM470110.1__N
  source 1..696: mol_type = other RNA
atgtcagagttcattttcaacgatgtaccacaacggactacatcttcatttgatccggaggcagcatatgtggcatttgaagctagatacggacaagtgctcaatgcttgtgttgttagagtcttcttcctcaaccaaaagaaggccaaagatgtcttacgtaagacatcgtggcccatggttgaccttacttttggtcgggtccaatttgcaatggttaataaccatttcccacagttccagtcgaatccagtgccggacaacggtcttgccctgcaccgtctgtcaggatacctagcgcgctgggcctttacccagatgcgttcaccaattaagcaagctgagttcagagccactgtagtagtgcctttggctgaggtaaagggctgcacttggaatgatggtgacgcaatgtacctggggtttgctgctggtgctgagatgttcctgcaaacattcactttcttccctttggtgattgagatgcatagggttctgaaggatggcatggatgtcaactttatgaagaaagtcctccggcaacgatatggccaaaagactgccgagcaatggatgcgtgaagaaatagtcgctgtaagagcagcttttgaagctgtaggcactctggcctgggccagaactggattctccccagcagcaagagacttcttgcgccaattcggaattgacatatag

SEQ ID NO: 3154 - RNA, 696 nt, synthetic construct
  misc_feature 1..696: note = derived and/or modified CDS sequence (wt) from OROV(BeH379693)__AF164534.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaagatgtcttacgtaggacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcgatcaccaattaagcaagctgagtttagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgctgagcaatggatgcgtgaagaaatagttgctgtaagagcagcttttgaagctgtaggcactctggcctgggccagaactggattctccccagcagcaagagacttcttgcgccaattcggaattggcatatag

SEQ ID NO: 3155 - RNA, 696 nt, synthetic construct
  misc_feature 1..696: note = derived and/or modified CDS sequence (wt) from OROV(BeH381114)__AF164535.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcgatcaccaattaagcaagctgagttcagagccactgtagtagtgcctttggctgaggtaaagggctgtacttggaatgatggtgacgcaatgtacctggggtttgctgctggtgctgagatgttcctgcagacattcactttcttccctttggtgattgagatgcatagggttctcaaggatggcatggatgtcaactttatgaagaaagtcctccggcaacggtatggtcaaaaaactgctgaacaatggatgcgtgaagaaatagttgctgtaagagcagcttttgaagctgtaggcactctggcctgggccagaactggattctccccagcagcaagagacttcttgcgccaattcggaatttgcatatag

SEQ ID NO: 3156 - RNA, 696 nt, synthetic construct
  misc_feature 1..696: note = derived and/or modified CDS sequence (wt) from OROV(BeH390233)__AF164536.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcgatcaccaattaaacaagctgagtttagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgctgagcaatggatgcgtgaagaaatagttgctgtaagagcagcttttgaagctgtaggcactctggcctgggccagaactggattctccccagcagcaagagacttcttgggccaattcggaattgggatatag

SEQ ID NO: 3157 - RNA, 696 nt, synthetic construct
  misc_feature 1..696: note = derived and/or modified CDS sequence (wt) from OROV(BeH472204)__AF164538.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcgatcaccaattaagcaagctgagtttagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatgtccaaaaaactgccgagcaatggatgcgtgaagaaatagttgctgtaagagcagcttttgaagctgtaggcactctggcctgggccagaactggattctccccagcagcaagagacttcttgcgccaattcggaattggcatatag

SEQ ID NO: 3158 - RNA, 696 nt, synthetic construct
  misc_feature 1..696: note = derived and/or modified CDS sequence (wt) from OROV(BeH505442)__AF164542.1__N
  source 1..696: mol_type = other RNA
atgtcagaattcattttcaatgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacaattccagtcgaatccagtgccggacaacggtcttaccttgcaccgtctgtcgggatacctagctcgctgggcctttacccagatgcggtcaccaattaaacaagctgagtttagggccactgtggtagtgcctttggcagaggtgaagggctgtacttggaatgatggtgatgcaatgtatctggggtttgctgccggtgctgagatgtttctgcaagcattcactttcttccctttggtgattgagatgcacagggtcctcaaggacggcatggatgtcaattttatgaaaaaagtccttcggcagaggtatggccagaagactgctgagcaatggatgcgtgaagaaatagttgctgtaagagcagcttttgaggctgtaggcactctggcctgggccaggactggattctccccagcagcaagagacttcttgcgccaattcggaattgacatatag

SEQ ID NO: 3159 - RNA, 696 nt, synthetic construct
  misc_feature 1..696: note = derived and/or modified CDS sequence (wt) from OROV(BeH541863)__AF164544.1__N
  source 1..696: mol_type = other RNA
atgtcagagttcattttcagcgatgtaccacaacggactacatctacatttgatccggaggcagcatatgtggcatttgaagctagatacggacaagtgctcaatgctggtgttgttagagtcttcttccttaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcgatcaccaattaagcaagctgagtttagagccactgtagtagtgcctttggctgaggtaaagggctgtacttggaacgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgccgagcaatggatgcgtgaagaaatagttgctgtaagagcagcttttgaagctgtaggcactctggcctgggccagaactggattctccccagcagcaaggaacttcttgcgccaattcggaattggcatatag

SEQ ID NO: 3160 - RNA, 696 nt, synthetic construct
  misc_feature 1..696: note = derived and/or modified CDS sequence (wt) from OROV(BeH543033)__AF164545.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcggtcaccaattaagcaagctgagtttagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgccgagcaatggatgcgtgaagaaatagttgctgtaagagcagcttttgaagctgtaggcactctggcctgggccagaactggattctccccagcagcaagagaattcttgcgccaattcggaattggcatatag

SEQ ID NO: 3161 - RNA, 696 nt, synthetic construct
  misc_feature 1..696: note = derived and/or modified CDS sequence (wt) from OROV(BeH543618)__AF164548.1__N
  source 1..696: mol_type = other RNA
atgcaagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcggtcaccaattaagcaagctgagtttagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgccgagcaatggatgcgtgaagaaatagttgctgtaagagcagcttttgaagctgtaggcactctggcctgggccagaactggattctccccagcagcaagagacttcttgcgccaattcggaattggcatatag

SEQ ID NO: 3162 - RNA, 696 nt, synthetic construct
  misc_feature 1..696: note = derived and/or modified CDS sequence (wt) from OROV(BeH544552)__AF164546.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaggatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagctcgctgggcctttacccagatgcgatcaccaattaagcaagctgagtttagagccactgtagtagtgcctttggctgaggtaaagggctgtacttggaatgatggtgacgcaatgtacctggggtttgctgctggtgctgagatgttcctgcaaacattcactttcttccctttggtgattgagatgcatagggttctcaaggatggcatggatgtcaactttatgaagaaagtcctccggcaacgatatggccaaaaaactgccgagcaatggatgcgtgaagaaatagttgctgtaagagcagcttttgaagctgtaggcactctggcctgggccagaactggattctccccagcagcaagagacttcttgcgccaaatcggaattggcatatag

SEQ ID NO: 3163 - RNA, 696 nt, synthetic construct
  misc_feature 1..696: note = derived and/or modified CDS sequence (wt) from OROV(GML444911)__AF164556.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttccttaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcgggatacctagctcgctgggcatttacccagatgcgatcaccaattaagcaagctgagttcagggccactgtggtagtgcctttggcagaggtgaagggctgtacttggaacgacggtgacgcaatgtatctgggatttgctgctggtgctgaaatgtttctgcagacattcactttcttccctttggtgattgagatgcacagggtcctcaaggacggtatggatgtcaactttatgaagaaagttctccggcagaggtacggtcagaaaactgctgagcaatggatgcgtgaagaaatagttgctgtaagagcagcctttgaggctgtaggcactctggcctgggccaggactggtttctctccagcagcaagagacttcttgcgccaattcggaatttacatatag

SEQ ID NO: 3164 - RNA, 696 nt, synthetic construct
  misc_feature 1..696: note = derived and/or modified CDS sequence (wt) from OROV(IQT4083)__AF164552.1__N
  source 1..696: mol_type = other RNA
atgtcagagtttattttcaatgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacaattccagtcgaatccagtgccggacaacggtcttaccttgcaccgtctgtcgggatacctagctcgctgggcctttacccagatgcggtcaccaattaagcaagctgagtttagggccactgtggtagtgcctttggcagaggtgaagggctgtacttggaatgatggtgatgcaatgtatctggggtttgctgccggtgctgagatgtttctgcagacattcactttcttccctttggtgattgagatgcacagggtcctcaaggacggcatggatgtcaactttatgaagaaagtccttcggcaaaggtatggcaaaaagactgccgagcaatggatgcgtgaagaaatagttgctgtaagagcagcttttgaggctgtaggcactctggcctgggccaggactggattctccccagcagcaagagacttcttgcgccaattcggaattgacatatag

SEQ ID NO: 3165 - RNA, 696 nt, synthetic construct
  misc_feature 1..696: note = derived and/or modified CDS sequence (wt) from OROV(PPS 522 H 669314)__EF467370.1__N
  source 1..696: mol_type = other RNA
atgtcagagttcatttccaacgatgtaccacatcggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtctgtcaggatacctagcgcgctgggcctttacccagatgcgatcaccaattaagcaagctgagttcagagccactgtagtagtgcctttggctgaggtaaagggctgtacttggaatgatggtgacgcaatgtacctggggtttgctgctggtgctgagatgttcctgcagacattcactttcttccctttggtgattgagatgcatagggttctcaaggatggcatggatgtcaactttatgaagaaagtcctccggcaacggtatggtcaaaaaactgctgaacaatggatgcgtgaagaaatagttgctgtaagagcagcttttgaagctgtaggcactctggcctgggccagaactggattctccccagcagcaagagacttcttgcgccaattcggaatttgcatatga

SEQ ID NO: 3166 - RNA, 696 nt, synthetic construct
  misc_feature 1..696: note = derived and/or modified CDS sequence (wt) from OROV(TVP-19254/GML-480914)__KP795083.1__N
  source 1..696: mol_type = other RNA
atgtcagagttcattttcaacgatgtaccacaacggactacatctacatttgatccggaggcagcatatgtggcatttgaagctagatacggacaagtgctcagtgctggtgttgttagagtcttcttcctcaaccaaaagaaggccaaagatgtcttacgtaagacatcgaggcccatggttgaccttacttttggtggggtccaatttgcaatggttaataaccatttcccacagttccagtcgaatccagtgccggacaacggtcttaccctgcaccgtttgtcaggatacctagctcgctgggcctttacccagatgcgatcaccaattaagcaagctgagtttagagccactgtagtagtgcctttggctgaggtaaagggctgtacttggaatgatggtgatgcaatgtacctggggtttgctgctggtgctgagatgttcctacaaacattcactttctttcctttggtgattgagatgcatagggttctcaaggatggcatggatgtcaactttatgaagaaagtcctccggcaacgatatggccaaaaaactgccgagcaatggatgcgtgaagaaatagttgctgtaagggcagcttttgaagctgtaggcactctggcctgggccagaactggattctccccagcagcaagagacttcttgcgccaattcggaattgatatatag

SEQ ID NO: 3167 - RNA, 696 nt, synthetic construct
  misc_feature 1..696: note = derived and/or modified CDS sequence (wt) from OROV(TVP-19256/IQE-7894)__KP795086.1__N
  source 1..696: mol_type = other RNA
atgtcagagttcattttcaacgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgcggcccatggttgaccttacttttggtggggtccaatttacaatggttaataaccatttcccacaattccagtcgaatccagtgccggacaacggtcttaccctgcaccgtctgtcaggatacctagctcgctgggcctttacccagatgcgatcaccaattaagcaagctgagtttagggccactgtggtagtgcctttggcagaggtgaagggctgtacttggaatgatggtgacgcaatgtacctggggtttgctgctggtgctgagatgtttctgcaaacattcactttcttccctttggtgattgagatgcatagggtcctcaaggacggcatggatgtcaactttatgaagaaagtccttcggcagaggtatggccagaagactgctgaacaatggatgcgcgaagaaatagttgctgtaagagcagcttttgaggccgtaggcactctggcctgggccaggactggattctccccagcagcaagagacttcttgcgccaatttggaattgacatatag

SEQ ID NO: 3168 - RNA, 696 nt, synthetic construct
  misc_feature 1..696: note = derived and/or modified CDS sequence (wt) from OROV(TVP-19258/IQT-4083)__KP795092.1__N
  source 1..696: mol_type = other RNA
atgtcagagttcattttcaatgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgaggcccatggttgaccttacttttggtggggtccaatttgcaatggttaataaccatttcccacaattccagtcgaatccagtgccggacaacggtcttaccttgcaccgtctgtcgggatacctagctcgctgggcctttacccagatgcggtcaccaattaaacaagctgagtttaggggcactgtggtagtgcctttggcagaggtgaagggctgtacttggaatgatggtgatgcaatgtatctggggtttgctgccggtgctgagatgtttctgcagacattcactttcttccctttggtgattgagatgcacagggtcctcaaggacggcatggatgtcaactttatgaagaaagtccttcggcagaggtatggccaaaagactgctgagcaatggatgcgtgaagaaatagttgctgtaagagcagcttttgaggctgtaggcactctggcctgggccaggactggattctccccagcagcaagagacttcttgcgccaattcggaattgacatatag

SEQ ID NO: 3169 - RNA, 699 nt, synthetic construct
  misc_feature 1..699: note = derived and/or modified CDS sequence (wt) from OROV/FPV(Aus Ch 16129)__AF362400.1__N
  source 1..699: mol_type = other RNA
atgactgactttgtgttcaacgatgtaccacaacgggctacgtctacgtttgatccggaggcggcatatgtggcatttgaaaatcgtttcagagcgaatctcactgttgatgtcgctcgaattttcttcctcaaccagaagaaggccaaggatcgtcttgctaagacggcgagagcaactgttgatattacgtttggaggggtcgtctttccagtggttaacaaccattatccagaataccaacggaatccggtgccagatgacggccttaccttgcacaggctctctgggtacctggctagatggttgatcgatcaatgcaatgcaagccctgtccggatgaccgagatcaggacaaaagtgattattcctcttgcagaagtgaaaggttgcacctggaatgatggtgcatcaatgtacctcggatttgctgctggagctgaaatgtttctccagagcttcacattctatcctctagtgatagaaatgcagagagtcttgaaggatggaatggatgtaaactttatgcgcaaagtattgcgccaaagatatgggaccaaaaccgcagaacaatggatgagagatgacatcgttgcagttaaaactgcatttgaggccattaatacaatctcatgggccagatctggattctctcctgctgcaagagagttcttgcgccaatttggcattaacatctaa

SEQ ID NO: 3170 - RNA, 696 nt, synthetic construct
  misc_feature 1..696: note = derived and/or modified CDS sequence (wt) from OROV/IQTV(IQE3728/PER/06)__KF150535.1__N
  source 1..696: mol_type = other RNA
atgtcagagttcattttcaatgatgtaccacaacggactacatctacatttgatccggaggcagcatatgtggcatttgaagctagatacggacaagtgctcaatgctggtgttgttagagtcttcttcctcaaccaaaagaaggccaaagatgtcttacgtaagacatcgcggcccatggttgaccttacttttggtggggtccaatttgcaatggttaataaccatttcccacaattccagtcgaatccagtgccggacaacggtcttaccctgcaccgtctgtcgggatacctagctcgctgggcctttacccaaatgagatcaccaattaagcaagctgagtttagggccactgtggtagtgcctttagcagaggtgaagggctgtacttggaatgatggtgacgcaatgtacctagggtttgctgccggtactgagatgtttctgcagacgttcacttttttccctttggtgattgagatgcacagggtccttaaggacggcatggatgtcaactttatgaagaaagtcctccgacagaggtatggccagaagactgctgaacaatggatgcgtgaagaaatagttgctgtaagagcagcttttgaggctgtaggcactctggcctgggccaggaccgggttctccccagcagcaagagacttcttgcgccaattcggaattggcatatag

SEQ ID NO: 3171 - RNA, 699 nt, synthetic construct
  misc_feature 1..699: note = derived and/or modified CDS sequence (wt) from OROV/UTIV(Be An 84785)__KF697156.1__N
  source 1..699: mol_type = other RNA
atggcagaatttgtatttaatgatgtcccccagaggtctacatcaacatttgacccagaggtggcctatgctacttttgaagcagcatttcgccagactctaaatgtcaatgttgttagagtgttctttttaaaccaaaagaatgctaaaaatgttttgagaaaaacctcaagaccaaatgtggacttgacatttgggggtgcaacctttccaattgtcaacaaccattttcctcaatttcaatcaaatccagtccctgacaacggactcactctccatagattgtcaggctatttagctagatggtctatggatcaaatgcgaaccaacccaattcgtcaagctgaatttagggctgctgtagtagtccctcttgctgaaattaaggggtgcacttggaatgatggtgatgctatgtacttagcctttgctgcaggagctgaaatgtttttaaacacctttacttttttcccgctggttattgagatgcacagagtcctcaaggatggcatggatgttaatttcatgaggaaagtactaagacaaagatatgggacaaaaacagctgagcaatggatgaaggacgaaattatcccaatcaaggcagcctttgaagctgttggtatgctgagctgggctagaactggattctctcctgctgcaagagacttcttgcgccaatttggaatcaatgtctaa

SEQ ID NO: 3172 - RNA, 738 nt, synthetic construct
  misc_feature 1..738: note = derived and/or modified CDS sequence (wt) from HRTV(TN)__KJ740146.1__N
  source 1..738: mol_type = other RNA
atgactgactggtctgcaatagctgttgagattggcaacgagccactggatgttccagctttggtcgagtttgcaaaggagatagcttatgagggcctggatcctgctgtgatcttggggctgcttcgtgagagagggggtgagaactggaggaatgatgtgaagtacatcattgtatttgctctcaccagagggaacaagatagtgaaagcatgtggcaagatgtctaagaaaggcgctgagaggatgacaaacctggctagagtctatgagctgaaggagaatgctgttgacagaatggctgtaacaccagtgagagttgcccagtgcctgccaacctggacctgtgctgctgcagcagcaatcaaggagtacctccctgttggaccagcaatcatgcacaacaaaatccaaggttatccactggaaatgatgtgcatggcctttggctcattgatcccacaggcagatgtctccattgaagtcataaaggacttcatggatgcctattccctttggcaagacacatttgctcgaacaatcaatgtggaccaaaggaagatgacaaaggcagaggtgtatgccaaattcagagaccctctgcatgcagctgtcaattccctcttcttcccaaatgccaccaggatcagctggctgcaggccaagggcttgctcacagcaaccaaggaagcatccggctcagtgaaggctgcagctgctgcttacagaaacatgtaa

SEQ ID NO: 3173 - RNA, 738 nt, synthetic construct
  misc_feature 1..738: note = derived and/or modified CDS sequence (wt) from HRTV(Patient1)__JX005842.1__N
  source 1..738: mol_type = other RNA
atgactgactggtctgcaatagctgttgagattggcaacgagccactggatgttccagctttggtcgagtttgcaaaggagatagcttatgagggcctggatcctgctgtgatctttgggctgcttcgtgagagggggggtgagaactggaggaatgatgtgaagtacatcattgtatttgctctcactagagggaacaagatagtgaaagcatgtggcaagatgtctaagaaaggcgctgagaggatgacaaacctggctagagtctatgagctgaaggagaatgctgttgacagaatggctgtgacaccagtgagagttgcccagtgcctgccaacctggacctgtgctgctgcagcagcaatcaaggagtacctccctgttgggccagcaatcatgcacaacaagatccaaggttatccactggaaatgatgtgcatggcctttggctcattgatcccacaggcagatgtctcaattgaagtcataaaggacttcatggatgcctactccctttggcaagacacatttgctcgaacaatcaatgtggaccaaaggaagatgacaaaggcagaggtgtatgccaaattcagagaccctctgcatgcagctgtcaattccctcttcttcccaaatgccaccaggatcagctggctgcaggccaagggcttgctcacagcaaccaaggaagcatccggctcagtgaaggctgcagctgctgcttacagaaacatgtaa

SEQ ID NO: 3174 - RNA, 738 nt, synthetic construct
  misc_feature 1..738: note = derived and/or modified CDS sequence (wt) from HRTV(Patient2)__JX005843.1__N
  source 1..738: mol_type = other RNA
atgactgactggtccgcaatagctgttgagattggcaacgagccactggatgttccagctttggtcgagtttgcaaaggaaatagcttatgagggcctggatcctgctgtgatcttggggctgcttcgtgagagagggggtgagaactggaggaatgatgtgaagtacatcattgtatttgctctcaccagagggaacaagatagtgaaagcatgtggcaagatgtctaagaaaggcgctgagaggatgacaaatctggctagagtttatgagctgaaggagaatgctgttgacagaatggctgtgacaccagtgagagttgcccagtgcctgccaacctggacctgtgctgctgcagcagcaatcaaggagtacctccctgttgggccagcaatcatgcacaacaaaatccaaggttatccactggaaatgatgtgcatggcctttggctcactgattccacaggcagatgtctcaattgaagtcataaaggacttcatggatgcctattccctttggcaagacacatttgctcgaacaatcaatgtggaccaaaggaagatgacaaaggcagaggtgtatgccaaattcagagaccctctgcatgcagctgtcaattccctcttcttcccaaatgccaccaggatcagctggctgcaggccaagggcttgctcacagcaaccaaggaagcatccggctcagtgaaggctgcggctgctgcttacagaaacatgtaa

SEQ ID NO: 3175 - RNA, 732 nt, synthetic construct
  misc_feature 1..732: note = derived and/or modified CDS sequence (wt) from PTV(PAN472868)__NC_027202.1__N
  source 1..732: mol_type = other RNA
atgtcatacgaggagattgccgttcagtttgcctctgagtctatagatgagcaagctgttgccggttgggtgactgattttgcttatcaaggatttgatgcaaagagggtgatagctcttgtgaaagatcgtggaggtgaggactggaagcaggatgtcaagaagatgattgttctctctcttaccagaggcaacaagccaaacaaaatggttcttaagatgtcagacaagggcaaggcaatggtgaatgagctcgtgttgaaatacaagctcaagtcaggaaacccttctcgagatgacttgactctttccagaatcactgctgcttttgctggttggacatgtcaggctgctgattatgtccaggagtacttgccagtgactggcagagccatggatgccatatccagcagttatcctagggcgatgatgcatcccagctttgctggactgattgaccaagagcttccagcagatgtgttgtctgagataacccaagctcactgcttgttcatgatccaattctcaaagaccatcaacccctcactgagaggcttaagtaaggatgaaattgtctccagctttgagcggccaatgcaagctgcaatcagtagcacatttttaacatctgccaatagaagagcaatgttgaagactcttgggatcataaacgataacctaaagccctcatcttcaactgtgagtgctgcaaaagtcttcagatccctttga

SEQ ID NO: 3176 - RNA, 732 nt, synthetic construct
  misc_feature 1..732: note = derived and/or modified CDS sequence (wt) from PTV(Adames)__KR912210.1__N
  source 1..732: mol_type = other RNA
atgtcatacgaggagattgccgttcagtttgcctctgagtctatagatgagcaagctgttgccggttgggtgacagattttgcttatcagggatttgatgcaaagagagtgatagctcttgtgaaagagcgtggaggtgaggactggaagcaggacgtcaagaagatgattgttctctctcttaccagaggtaacaagccaaacaagatggttctcaagatgtcagacaagggcaaggcaatggtgaatgagctagttttgaagtacaagctcaaatctgggaatccttctcgagatgacctaactctctccagaatcactgctgcttttgctggttggacatgtcaggctgctgattatgttcaggagtacttgccagtgactggcagagctatggataccatatctagcggttatcctagagcaatgatgcatcccagctttgctggtttaattgatcaagagctcccagcagatgtgctgtctgagataacccaagctcactgcttgttcatgattcagttctctaagactatcaacccctcactgagaggtctaagcaaggatgaaatagtttctagctttgagcgaccaatgcaagccgcaattagcagcacattcttgacatctgccaacagaagagcaatgctgaagactcttgggatcataaatgacaacctgaagccttcatcctcaactgtgagtgctgcaaaagtcttcagatccctctag

SEQ ID NO: 3177 - RNA, 732 nt, synthetic construct
  misc_feature 1..732: note = derived and/or modified CDS sequence (wt) from PTV(Balliet)__KR912211.1__N
  source 1..732: mol_type = other RNA
atgtcatacgaagagattgccgttcagtttgcctctgagtctatagatgagcaaactgttgccggttgggtgactgattttgcttatcaaggatttgatgcgaagagggtgatagctcttgtgaaagatcgtggaggtgaggactggaagcaggatgtcaagaagatgattgttctctctcttactagaggcaacaagccaaacaaaatgattcttaaaatgtcagacaagggcaaggcaatggtgaatgagctcgtgttaaaatacaagctcaaatctggaaacccttctcgagatgacttgactctttccagaatcactgctgcttttgctggttggacatgtcaggctgctgattatgtccaggagtacttgccagtgactggcagagccatggatgccatatccagcagttatcctagggcgatgatgcatcccagctttgctggactgattgaccaagagcttccagcagatgtgttctctgagataactcaagctcactgcttgttcatgatccaattctcaaagactatcaacccctcactgagaggtttgagtaaggatgaaattgtctccagctttgagcgaccaatgcaagctgcaatcagcagtacatttttaacttctgccaatagaagagcaatgttgaagactcttgggatcataaatgataacctaaagccctcatcttcaactgtgagtgctgcaaaagtcttcagatccctttga

SEQ ID NO: 3178 - RNA, 732 nt, synthetic construct
  misc_feature 1..732: note = derived and/or modified CDS sequence (wt) from PTV(PaAR2381)__KP272006.1__N
  source 1..732: mol_type = other RNA
atgtcatacgaggagattgccgttcagtttgcctctgagtctatagatgagcaagcggttgccggttgggtgactgattttgcttatcaaggatttgatgcaaagagagtgatagctcttgtaaaggatcgtggaggtgatgactggaagcaagatgtcaagaagatgattgttctctctcttaccagaggcaacaagccaaacaagatggttctcaagatgtcagacaagggcaaggcaatggtgaatgagctcgtattgaaatacaagctcaaatctggaaacccttctcgagatgacttgactctttccaggatcactgctgcttttgctggttggacatgtcaggctgctgattatgtccaggagtacttgccagtgactggcagagccatggatgccatatccagcagttatcccagggcgatgatgcaccccagctttgctggtttgattgatcaagagcttccagcagatgtattgtctgagataacccaagctcactgcttgttcatgatccaattctcaaagaccatcaacccctctctgagaggcttaagtaaggatgaaattgtctccagctttgagcgaccaatgcaggctgcaattagcagcacattcttgacatctgcaaacagaagagcaatgttgaagactcttgggatcataaatgacaacctgaagccctcatcttcaactgtgagtgctgcaaaagtcttcagatccctttaa

SEQ ID NO: 3179 - RNA, 732 nt, synthetic construct
  misc_feature 1..732: note = derived and/or modified CDS sequence (wt) from PTV(GML902876)__KP272012.1__N
  source 1..732: mol_type = other RNA
atgtcatacgaggagattgctgttcagtttgcctctgagtctatagatgagcaagcggttgccggttgggtgactgattttgcttatcaaggatttgatgcaaagagagtgatagctcttgtaaaggatcgtggaggtgatgactggaagcaagatgtcaagaagatgattgttctctctcttaccagaggcaacaagccaaacaagatggttctcaagatgtcagacaagggcaaggcaatggtgaatgagctcgtattgaaatacaagctcaaatctggaaacccttctcgagatgacttgactctttccaggatcactgctgcttttgctggttggacatgtcaggctgctgattatgtccaggagtacttgccagtgactggcagagccatggatgccatatccagcagttatcccagggcgatgatgcaccccagctttgctggtttgattgatcaagagcttccagcagatgtattgtctgagataacccaagctcactgcttgttcatgatccaattctcaaagaccatcaacccctctctgagaggcttaagtaaggatgaaattgtctccagctttgagcgaccaatgcaggctgcaattagcagcacattcttgacatctgcaaacaggagagcaatgttgaagactcttgggatcataaatgacaacctgaagccctcatcttcaactgcgagtgctgcaaaagtcttcagatccctttaa

SEQ ID NO: 3180 - RNA, 732 nt, synthetic construct
  misc_feature 1..732: note = derived and/or modified CDS sequence (wt) from PTV(Adames)__KP272030.1__N
  source 1..732: mol_type = other RNA
atgtcatacgaggagattgccgttcagtttgcctctgagtctatagatgagcaagctgtcgccggttgggtgacgcattttgcttatcagggatttgatgcaaagagagtgatagctcttgtgaaagagcgtggaggtgaggactggaagcaggacgtcaagaagatgattgttctctctcttaccagaggtaacaagccaaacaagatggttctcaagatgtcagacaagggcaaggcaatggtgaatgagctagttttgaagtacaagctcaaatctgggaatccttctcgagatgacctaactctctccagaatcactgctgcttttgctggttggacatgtcaggctgctgattatgttcaggagtacttgccagtgactggcagagctatggataccatatctagcggttatcctagagcaatgatgcatcccagctttgctggtttaattgatcaagagctcccagcagatgtgctgtctgagataacccaagctcactgcttgttcatgattcagttctctaagactatcaacccctcactgagaggtctaagcaaggatgaaatagtttctagctttgagcgaccaatgcaagccgcaattagcagcacattcttgacatctgccaacagaagagcaatgctgaagactcttgggatcataaatgacaacctgaagccttcatcctcaactgtgagtgctgcaaaagtcttcagatccctctag

SEQ ID NO: 3181 - RNA, 735 nt, synthetic construct
  misc_feature 1..735: note = derived and/or modified CDS sequence (wt) from Phlebovirus(CoAr171616)__HM566153.1__N
  source 1..735: mol_type = other RNA
atgtcttacgaagagattgcggttaattttgcctctgagtcaattgatgagtcgacaatatctgcttgggtttctgactttgcttatcaaggttttgatgccaagagggtaattgctctcattaaagaaagaggaggtgagaactggaaggaagatgtcaagaaaatgattgttttgtcattgacccgaggaaacaagcctgctaagatgatcttgaagatgtctgataaaggtaagaaggaagtcaatgatctcataactcggtacaaactgaaatctggcaatccctctcgtgatgacttaactttgtcaagagttgctgctgcttttgctggatggacttgccaggctgctgagtatgtgcaggaatatttacctgtgacaggaagagcaatggatgctttctctgcagactttcctagagctctaatgcatcctagttttgctggtctgattgatcaagaactcccatcttctgccatgacagatattgtccatgcccattgcctgttcatgatacaattttcaaagacaattaatcctacaattcgttctgccagtaaggatgagattgtagcaagttttgatagaccgatgcaagctgccataaacagcaccttcttaacctctgcccagcgcagagccatgttgaagacacttggggtcataaatgacaacctcaaggtttcaactgctgtgtctagtgctgccaaagctttcaagaagctacaataa

SEQ ID NO: 3182 - RNA, 735 nt, synthetic construct
  misc_feature 1..735: note = derived and/or modified CDS sequence (wt) from Phlebovirus(CoAr171616)__EF201836.1__N
  source 1..735: mol_type = other RNA
atgtcttacgaggagattgcgattcattttgcctctgagtctatagatgagtcgacaatatctgcttgggtttctgactttgcttatcaaggttttgatgccaagagggtaattgctctcattaaagaaagaggaggtgagaactggaaggaagatgtcaagaaaatgattgttttgtcattgacccgaggaaacaagcctgctaagatgatcttgaagatgtctgataaaggtaagaaggaagtcaatgatctcataactcggtacaaactgaaatctggcaatccctctcgtgatgacttaactttgtcaagagttgctgctgcttttgctggatggacttgccaggctgctgagtatgtgcaggaatatttacctgtgacaggaagagcaatggatgctttctctgcagactttcctagagctctaatgcatcctagttttgctggtctgattgatcaagaactcccatcttctgccatgacagatattgtccatgcccattgcctgttcatgatacaattttcaaagacaattaatcctacaattcgttctgccagtaaggatgagattgtagcaagttttgatagaccgatgcaagctgccataaacagcaccttcttaacctctgcccagcgcagagccatgttgaagacacttggggtcataaatgacaacctcaaggtttcaactgctgtgtctagtgctgccaaagctttcaagaagctacaataa

SEQ ID NO: 3183 - RNA, 732 nt, synthetic construct
  misc_feature 1..732: note = derived and/or modified CDS sequence (wt) from Phlebovirus(CoAr170255)__EF201840.1__N
  source 1..732: mol_type = other RNA
atgtcttatgaagaaattgcaatccagtttgctagtgaatctgttgatgccacaacaattgcagcatgggtatcagagtttgcttatcaaggctttgatgcaagacaagtgatcaacctggtcaagcagaggggaggagatgactggaaggaggatgtgaagaagatgattgtcctttcattaacaagagggaataagccatctaagatgctaaacaagatgtcagagagtggtcagaaaattgtgaatgacttgatcagcaagtacaagctcaaatctggaaacccaggccgcaatgatctcactctctcaaggattgccgctgcttttgctggttggacttgccaagcagcagaagttgttcaggactatttaccagtcactggcagggcaatggatgcgatatctgacaagtttcctagggcactgatgcatcccagctttgctggtcttgttgacccaacactaccagaaggtgtggttgaggacatagtgcatgctcactgcttattcatgattcagttttccaaaacaatcaatccatccctgagatcatcctcaaagagcgaggttgtgtctagcttcgaccgaccaatgcaggctgctataaacagtcccttcctcactgctgggaacaggagagatattctcatgtctcttggtctgataaactcaaatctgaagccctcaccagctgtgattgcagctgccaaggtttacaggaaattgtga

SEQ ID NO: 3184 - RNA, 732 nt, synthetic construct
  misc_feature 1..732: note = derived and/or modified CDS sequence (wt) from Buenaventura virus(CoAr3319)__KP272003.1__N
  source 1..732: mol_type = other RNA
atgtcttatgaagaaattgcaatccagtttgctagtgaatctgttgatgccacaacaattgcagcatgggtatcagagtttgcttatcaaggctttgatgcaagacaagtgatcaacctggtcaagcagaggggaggagatgactggaaggaggatgtgaagaagatgattgtcctttcattaacaagagggaataagccatctaagatgctaaacaagatgtcagagagtggtcagaaaattgtgaatgacttgatcagcaagtacaagctaaagtctggaaatccgggccgcaatgatctcacactctcaagaattgccgctgcttttgctggttggacttgccaagcagctgaagttgttcaggactatctgccagtaacaggcagggcaatggatgctatatctgacaagtttcctagagcactaatgcatcccagcttcgctggccttgttgacccaacactgccagaaggcgtggtcgaagacattgtgcatgctcattgcttattcatgattcagttctctaagacaatcaatccatctctgagatcatcctcaaaaagcgaggtcgtgtccagttttgaccgacctatgcaggctgccataaacagtcccttcctcactgctggaaacaggagagacattctcatgtctcttggtctgataaactcaaatctgaaaccttctccaactgtggtagctgcagccaaagtttacagaaaattgtga

SEQ ID NO: 3185 - RNA, 732 nt, synthetic construct
  misc_feature 1..732: note = derived and/or modified CDS sequence (wt) from Cocle virus(GML244915)__KP272035.1__N
  source 1..732: mol_type = other RNA
atgtcatacgaagaaattgccgttcagtttgcctcagagtctatagatgagcaggctgttgctggatgggtgactgactttgcttatcaaggctttgatgcaaggagagttattgctctagttaaagatcgtggtggtgaggactggaaacaagatgtcaagaaaatgattgtcctttctcttacaagaggcaataaacctaacaagatggtactaaagatgtcagacaaggggaaagcaatggtgaatgagcttgtgctaaaatacaagctcaagtctgggaatccatctcgagatgatctgactctatccaggatcactgctgcatttgctggttggacatgtcaggcagctgattatgtccaggagtatctcccagtgactggtagagccatggatgcgatctcaagtgggtatcctagggccatgatgcacccaagctttgctgggctgatagaccaggagcttccagcagatgtattatctgagattactcaggcacactgcctattcatgattcagttctcaaagaccatcaatccttctcttagaggattgggcaaggatgagattgtttcaagctttgagagacccatgcaagctgcgattagtagtactttcttaacatctgccaacagaagagcaatgctgaagacactgggaatcataaatgacaacctgaagccctcttcttctacagttagtgctgccaaggttttcagatcactttaa

SEQ ID NO: 3186 - RNA, 732 nt, synthetic construct
  misc_feature 1..732: note = derived and/or modified CDS sequence (wt) from Capira virus(VP-366G)__KP272044.1__N
  source 1..732: mol_type = other RNA
atgtcttacgaggagattgcgattcagtttgctagtgagtcaatcgatgagagcaccatcgctgcttgggtctctgactttgcttatcaaggttttgatgcaaaacaagttataatcctgatcaaaaagagaggaggagagaactggaaagaggatgtcaaaaagatgatagtgctctctttaactagaggcaacaagccttccaagatggtgaacaagatgtcagatgaaggtaagaaggtggttaatgaattgataagtaagtacaagctgaaaactggcaatcctgctcgagatgatttgacattatctagaattgcagctgcatttgctggttggacctgtcaagctgcagagtatgtccaggattatctgcctgtaaccggtagagctatggatgctctatctgataagtatccaagagctctgatgcatcctagctttgctggcttgattgaccctactcttccagatgatgcagtaaaagatattgtccatgctcattgtttgttcatgattcaattctccaagacaatcaacccatctctaaggtcttctacaaagacagagattgtcaatagctttgataggccaatgcaggctgccataaatagcccctttctgactgctgagaacagacgtgctatgttgaccactctaggggtgatcaattccaatcttaagccatccgctgctgttgttgctgcagccaaagcctaccgtaaattgtaa

SEQ ID NO: 3187 - RNA, 732 nt, synthetic construct
  misc_feature 1..732: note = derived and/or modified CDS sequence (wt) from Campana virus(VP-334K)__KP272042.1__N
  source 1..732: mol_type = other RNA
atgtcttacgaagagatagctatccaatttgcaagcgaatctgtagatgcaacaactattgctgcgtgggtttcggaatttgcttatcaaggctttgatgcaagacaagtgataaatctggttaagcagagaggaggggatgactggaaagaggatgttaaaaagatgattgtactgtcattgacaaggggaaacaaaccatctagaatggtgactaagatgtcagaaagtgggcagaaaattgtaaatgacctgataagcaagtataagctgaagtctgggaatcctggcagaaatgacctaacattatcgagagttgctgctgcttttgctgggtggacatgtcaggctgctgaggttgttcaagactatctccccgtaactggaagagcaatggatgctttatcagataaatttcctagagctatcatgcatcctagctttgcgggccttattgaccctacacttccagagaatgtggtagaggatattgttcacgctcactgcttgttcatgatacaattctctaagacaatcaacccgtctctaagatcatcctcaaaaagtgaggttgtctctagctttgatagaccaatgcaagctgcaataaacagtccttttcttactgctgcaaacaggagggacatgctcatgtctcttggcctcataagttccaacctgaagccctctgcagctgtcactgctgctgccaaggcctataggaagctataa

SEQ ID NO: 3188 - RNA, 738 nt, synthetic construct
  misc_feature 1..738: note = derived and/or modified CDS sequence (wt) from RVFV(ZH-548)__DQ380151.1__N
  source 1..738: mol_type = other RNA
atggacaactatcaagagcttgcgatccagtttgctgctcaagcagtggaccgcaatgagattgaacagtgggtccgagagtttgcttatcaagggtttgatgcccgtagagttatcgaactcttaaagcagtatggtggggctgactgggagaaggatgccaagaaaatgattgttctggctctaactcgtggcaacaagcccaggaggatgatgatgaaaatgtcgaaagaaggcaaagcaactgtggaggctctcatcaacaagtataagctaaaggaagggaatccttcccgggatgagttgactctatcacgagttgctgccgccttggctggctggacatgccaggctttggtcgtcttgagtgagtggcttcctgtcactgggactaccatggacggcctatcccctgcatacccgaggcatatgatgcaccccagctttgctggcatggtggatccttctctaccaggagactatctaagggcaatattagatgctcactctctgtatctgctgcagttctcccgggtcatcaacccaaacctccgaggtagaacaaaagaggaggttgctgcaacgttcacgcagccaatgaatgcagcagtgaatagcaactttataagccatgagaagaggagagaattcttgaaagcctttggacttgtggattccaatgggaagccgtcagctgctgtcatggcagccgctcaggcttacaagacagcagcctaa

SEQ ID NO: 3189 - RNA, 738 nt, synthetic construct
  misc_feature 1..738: note = derived and/or modified CDS sequence (wt) from RVFV(OV 35/74)__EF530207.1__N
  source 1..738: mol_type = other RNA
atggacaactatcaagagcttgcgatccagtttgctgctcaagcagtggaccgcaatgagattgaacagtgggtccgagagtttgcttatcaaggatttgatgcccgtagggttatcgaactcttaaagcagtatggtggggctgactgggagaaggatgccaagaaaatgattgttctggctctgactcgtggcaacaagccccggaggatgatgatgaaaatgtcgaaagaaggcaaagcaactgtggaggctctcatcaacaagtataagctaaaggaggggaatccttcccgggatgagttgactctatcacgagttgctgctgccctggctggctggacttgccaggctttggtcgtcttgagtgagtggcttcctgtcactgggaccaccatggatggcctatcccctgcatacccaaggcatatgatgcaccccagctttgctggcatggtggacccttctctaccagaagactatctaagggcaatattggatgctcactctctgtatctgctgcagttctcccgggtcatcaacccaaacctccgaggtagaacaaaggaggaggttgccgcaacgttcacgcagccaatgaatgcagcagtgaatagcaactttataagccatgagaagaggagagaattcttgaaagcttttgggcttgtggattccaatgggaagccgtcagcagctgtcatggcagctgctcaggcgtacaagacagcagcctaa

SEQ ID NO: 3190 - RNA, 762 nt, synthetic construct
  misc_feature 1..762: note = derived and/or modified CDS sequence (wt) from SFNV(Toscana)__NC_006318.1__N
  source 1..762: mol_type = other RNA
atgtcagacgagaattatcgcgatattgctcttgcttttcttgatgagtctgcagattctgggaccatcaatgcatgggtgaatgagtttgcttaccaagggtttgatccaaagcgcattgttcagttggtcaaggagagaggaacggcaaagggcagggactggaagaaagatgtgaagatgatgattgtgctgaaccttgtcaggggaaacaagccagaggccatgatgaagaagatgtcagagaagggtgcttctattgtggccaacctgatttcagtctaccagttgaaagaagggaaccctggcagggacaccatcactctgtcaagggtgtcagccgcatttgttccgtggactgttcaggcactacgtgtcctgtcagaatccctgcccgtgtctgggaccactatggatgccattgctggtgtaacctacccaagagccatgatgcaccctagctttgctgggatcattgatctggaccttccgaatggagctggagccactattgctgatgctcatgggctgttcatgattgagttctcaaagaccataaatccatctctgagaacaaaacaggctaatgaagtggctgccacatttgaaaagcccaatatggccgccatgagtggacgattcttcaccagagaagataagaagaagctgctcatagcagtggggatcattgatgaggatcttgttctggcgtctgcagtagtgaggagtgctgagaagtatcgcgccaaggttggcaagtga

SEQ ID NO: 3191 - RNA, 762 nt, synthetic construct
  misc_feature 1..762: note = derived and/or modified CDS sequence (wt) from SFNV__HM566170.1__N
  source 1..762: mol_type = other RNA
atgtctgaggagaactatcgtgagattgccttagccttccttgatgaagctgcagactcaggcactattactgcctgggtgaatgagtttgcttaccaggggttcgacccaaagaggatcgtccagctggtgaaggagagagggaccgccaaggggagagactggaagaaagacgttaaaatgatgatagtcctcaaccttgtgagaggcaacaagcctgaggccatgatgaagaagatgtcagagaaaggtgctggaattgttgcccagttaatctctgtataccagctcaaggaaggaaaccctggcagagacactatcacattgtctagagtctctgctgcttttgttccttggaccattcaggcacttagggtactttctgactccctcccggtcacagggacaacaatggatgctattgctggtgtaacttatccgagagccatgatgcaccctagcttcgctggtatcattgacctggaccttcctaacagggctggtgaagtaattgctgatgcacatggtctgttcatgctagagttttctaagactatcaacccatctctgagaaccaagcagcccaatgagatagcggctacatttgaaaaaccaaacatggctgctatgagtggtaggttcttcactagggaggacaaaaagaagctcttaatggctgttgggatactcaatgaagaccttgtgctaacaccagccatagttaagtgtgccgagaagtactgctctaaggtgggcaagtag

SEQ ID NO: 3192 - RNA, 735 nt, synthetic construct; identical to SEQ ID NO: 3181
  misc_feature 1..735: note = derived and/or modified CDS sequence (wt) from SFNV(Namru)__HM566168.1__N
  source 1..735: mol_type = other RNA

SEQ ID NO: 3193 - RNA, 762 nt, synthetic construct
  misc_feature 1..762: note = derived and/or modified CDS sequence (wt) from SFNV(NAMRU 840055)__EF201828.1__N
  source 1..762: mol_type = other RNA
atgtcagaggagaattaccgtgagattgccttggcttttcttgatgaagctgcagactcaggcactatcaccgcttgggtgaatgagtttgcttatcaaggatttgacccaaaaagaatagtccagctagtaaaagagagagggactgctaaggggagggactggaagaaagatgtcaagatgatgatagtccttaacctagtacggggcaacaagcctgaggccatgatgaagaagatgtcagagaagggtgctggaattgttgcccagctaatctctgtgtatcagcttagagaagggaatcctggtagagacaccattacattgtctagagtctcagctgcatttgttccttggactattcaggccctgaaggtgctctctgactctctccctgtcacagggacgacaatggatgctattgctggtgtggtgtacccaagagccatgatgcatcctagctttgcaggtatcattgacttggatcttccaaacagggctggtgaggccattgctgatgcacatggtttattcatgttggagttttctaagaccattaatccatctctgagaaccaagcagcccaatgaaattgcagccacatttgaaaaaccaaacatggcagcaatgagtggccggttctttactagggaggacaagaaaaagctcttgatggctgttggaatactcaatgaagaccttgtgctgaccccagctatagtcaagtgtgctgagaagtatcgctccaaagtgggcaagtga

SEQ ID NO: 3194 - RNA, 762 nt, synthetic construct
  misc_feature 1..762: note = derived and/or modified CDS sequence (wt) from SFNV(NAMRU 840055)__EF201829.1__N
  source 1..762: mol_type = other RNA
atgtctgaggagaactatcgtgagattgccttagccttccttgatgaagctgcagactcaggcactattactgcctgggtgaatgagtttgcttaccaggggttcgacccaaagaggatcgtccagctggtgaaggagagagggaccgccaaggggagagactggaagaaagacgttaaaatgatgatagtcctcaaccttgtgagaggcaacaagcctgaggccatgatgaagaagatgtcagagaaaggtgctggaattgttgcccagttaatctctgtataccagctcaaggaaggaaaccctggcagagacactatcacattgtctagagtctctgctgcttttgttccttggaccattcaggcacttagggtactttctgactccctcccggtcacagggacaacaatggatgctattgctggtgtaacttatccgagagccatgatgcaccctagcttcgctggtatcattgacctggaccttcctaacagggctggtgaagcaattgctgatgcacatggtctgttcatgctagagttttctaagactatcaacccatctctgagaaccaagcagcccaatgagatagcggctacatttgaaaaaccaaacatggctgctatgagtggtaggttcttcactagggaggacaaaaagaagctcttaatggctgttgggatactcaatgaagaccttgtgctaacaccagccatagttaagtgtgccgagaagtactgctctaaggtgggcaagtag

SEQ ID NO: 3195 - RNA, 762 nt, synthetic construct
  misc_feature 1..762: note = derived and/or modified CDS sequence (wt) from SFNV(P-7101795)__EF201830.1__N
  source 1..762: mol_type = other RNA
atgtctgaggagaattatcgtgagattgccttggccttccttaatgaagcagcagactcgggcactatcactgcctgggttaatgaatttgcctaccaggggtttgatcctaaaagaatcgttcaactggtaaaagagagaggaactgctaaaggaagggactggaaaaaggatgttaagatgatgattgtcctcaatcttgtaagaggaaacaagcctgagaccatgatgaagaagatgtcagagaagggagctgggattgttgctcaactgatttctgtttaccagctgaaagagggaaatcctggcagggacaccatcacgttatccagggtctcagctgcttttgttccttggaccgttcaggctctaagggtgctttctgattctctccctgtaactgggaccactatggatgccatcgcaggtgtgacatatccaagggctatgatgcaccccagcttcgcagggatcatagatctagacctgcctaatagagctggtgaaaccattgctgacgcacatggtctcttcatgctagagttctccaagaccatcaacccatcccttagaactaaacagcctaatgagattgcagccacttttgaaaaaccaaatatggcagcaatgagtggccggtttttcaccagggaagacaaaaagaaacttctgatggctgttggagtgctcaacgaggaccttgtgttgacaccagccatagtcaaatgtgctgaaaaatatcgctccaaggtaggcaaatag

SEQ ID NO: 3196 - RNA, 762 nt, synthetic construct
  misc_feature 1..762: note = derived and/or modified CDS sequence (wt) from SFNV(P-7101795)__EF201832.1__N
  source 1..762: mol_type = other RNA
atgtctgaggagaattatcgtgagattgccttggctttccttgatgaagctgcagactcaggtaccatcactgcctgggtgaatgagtttgcttatcagggatttgacccaaaaaggattgtccagctagtaaaagagaggggaactgccaaaggaagggactggaagaaagatgttaagatgatgatagtccttaacctagtaaggggcaacaaacctgaggctatgatgaagaagatgtcggagaagggtgctggaattgttgcccagctaatttctgtatatcagcttagagaagggaatcctggtagagataccatcacattatctagagtctcagctgcctttgttccttggaccattcaggctctgaaagtgctctctgattccctccctgtcacagggacaacaatggatgccattgctggtgtgatgtacccacgggctatgatgcatcctagctttgcaggcatcattgatttggatcttccaaacagggctggtgaagccattgctgatgcacatggtctattcatgttggagttctctaaaaccatcaatccatccttgagaaccaagcagcctaatgagattgcggccacatttgaaaaaccaaacatggcagcaatgagcggccggttctttactagggaggacaagaagaagctcttgatggctgttggaatactcaatgaagaccttgtgctgactccagctataatcaagtgtgctgagaagtatcgctctaaagtgggcaagtaa

SEQ ID NO: 3197 - RNA, 762 nt, synthetic construct
  misc_feature 1..762: note = derived and/or modified CDS sequence (wt) from Arrabida virus(PoSFPhlebV/126/2008)__KP863801.1__N
  source 1..762: mol_type = other RNA
atgtctgaagataactacagaacaatcgccctagcatttttggacgagtctgcagactcaactaccatcaatgcctgggtcaatgagttcgcttaccaagggtttgaccctaaaaggattgtgcaattggtgaaagagagagggactgccaaaggcagggattggaaaaaagatgttaagatgatgattgtcctgaacttggtgagaggcaacaagccagagagcatgatgaagaaaatgtccgaaaagggagccgccattgtcacccagctaatctccacctatcagctgaaggaagggaatcctggtagggacactatcaccttatccagggtttctgctgcttttgtgccatggaccgttcaagctctgaagacattgtcagaatccttgcctgtgactgggaccacgatggacagcattgctgggacaacttatcccaggtgcatgatgcatccaagctttgctggaataattgaccttgagctcccaaacaatactggtgctatgctggctgacgcacatgggcttttcatgttggagttctcaaagaccatcaatccatctctgagaaccaagcagccaaatgagattgctgcgacatttgagaaacccaacatggctgctatgactggacgtttcttcactagagatgataagaagaagctgctcattgccattggggttctcgatgaagacctagtgccaaacccggccattgagaagtgtgctgagaagtacaaggccaaggttgggaagtga

SEQ ID NO: 3198 - RNA, 765 nt, synthetic construct
  misc_feature 1..765: note = derived and/or modified CDS sequence (wt) from Gordil virus(Dak ANBr 496d)__KF297902.1__N
  source 1..765: mol_type = other RNA
atgtctgaggaaaactaccgagagatcgccatggcttttgccaatgattcagctgatttcaacatgatttcagtttgggctaatgactttgcttaccaaggatttgatcccaaaaggatcgtcgaacttgtgcggcagagaggcttggctaaggctcgcaattggaagcaggatgttaagatgatgatagtcctgaatctgatgagaggcaacaaaccagaagcaatggtgaggaagatgcaggagaaaggacagagaattgttctggagttaatcagtgtttatgagctaaaagagggaaacccaggtagagatactattactctgtctagagtctctgctgcttttgtcccctggaccattatggccttgaggcaactggcagaaaatatacctgttactggctctattatggatagcatccttgatggtgctgtctatcccagggctatgatgcatcctagctttgctggaataattgaccttgagctacctgagggcagaggggctgaattggctgatgctcatgggttattcatgatagaattctccaagacgatcaacccttctctcagaactaaatcagccattgagattgccgcctcttttgagaagcctaatatggctgccatgactggaaatttcttcactaaggatgacaagcgcaagctactcaagcagatcggaattcttgatagtgacctaaaactgaccccagtgattgagaaagctgctgccttgtacagatccaagaccaataaataa

SEQ ID NO: 3199 - RNA, 762 nt, synthetic construct
  misc_feature 1..762: note = derived and/or modified CDS sequence (wt) from Granada virus(GR25)__GU135608.1__N
  source 1..762: mol_type = other RNA
atgtctgaggataactacagaacaatcgccctagcgtttttggacgagtctgcagactcaactaccattaatgcctgggtcaatgagttcgcttaccaagggtttgaccctaaaaggatcgtgcagttggtgaaggagagaggaactgcaaagggcagagattggaagaaggatgttaagatgatgattgtcctgaacttggtgagaggcaacaagcctgaaagcatgatgaagaagatgtctgagaaaggggctgccattgtaactcagctgatctccacctatcagctgaaagaagggaatcctgggagagacaccatcaccttgtctagagtttccgctgctttcgtgccatggactgttcaggccttgaagaccttgtcagaatctctgcctgtgaccgggacaacaatggacagcattgctggaacaacttatcctaggtgcatgatgcacccaagctttgctggcataattgatcttgaacttccaaacaacactggagctatgctggctgacgcacatgggctgttcatgctggagttctcaaagaccatcaacccatctcttagaaccaagcagcccaacgagattgctgcaacatttgagaagcccaacatggctgccatgactggacgattcttcaccagagatgataagaaaaagctgctcattgctatcggggttctcaatgaagacctagtgccaaatccagccattgagaagtgtgctgagaagtacaaggccaaagttggaaagtga

SEQ ID NO: 3200 - RNA, 762 nt, synthetic construct
  misc_feature 1..762: note = derived and/or modified CDS sequence (wt) from Massilia virus(127)__KT906102.1__N
  source 1..762: mol_type = other RNA
atgtctgaggacaactacagaacaatcgccctatcgtttttggacgagactgcagtctcaactagcattaatgcctgcgtcaatgagtttgcttaccaaggattcgaccctaagaggattgtgcaattggtgaaggagagaggaactgcaaagggcagagactggaagaaggatgtcaagatgatgatcgttctgaacttggtgagaggcaacaagccggaaagcatgatgaagaagatgtctgagaaaggggctgccattgtaactcagctaatttccacctatcagctgaaggaggggaatcctgggagagacaccattaccttgtccagagtctccgctgcttttgtgccatggactgttcaggctttgaagaccttgtcagaatctttgcctgtgaccgggacaacaatggacagcattgctgggacaacctatcctaggtgcatgatgcatccaagctttgcaggcataattgatcttgagcttcctaacaacactggtgctatgcttgctgacgcacatgggctgttcatgctggagttctcaaagaccattaacccatctctgaggaccaagcagcctaatgagattgctgcaacatttgagaagcccaacatggctgccatgactggacgattcttcaccagagatgacaagaaaaagctactcattgctatcggggttctcgatgaagacttggtgccaaatccagccattgaaaagtgtgctgagaagtacaaggccaaagttggaaagtga

SEQ ID NO: 3201 - RNA, 762 nt, synthetic construct
  misc_feature 1..762: note = derived and/or modified CDS sequence (wt) from Massilia virus(130)__KT906103.1__N
  source 1..762: mol_type = other RNA
atgtctgaggacaactacagaacaatcgccctatcgtttttggacgagactgcagactcaactagcattaatgcctgcgtcaatgagtttgcttaccaaggattcgaccctaagaggattgtgcaattggtgaaagagagagggactgccaaaggcagggattggaagaaagatgtcaagatgatgatcgttctgaacttggtgagaggcaacaagccggaaagcatgatgaagaagatgtctgagaaaggagctgccattgtaacccagctaatctccacctatcagctgaaagaaggaaaccctgggagagacaccatcacgttatctagagtttccgctgcttttgtgccatggactgttcaggctttgaagaccttgtcagaatctctgcctgtgaccgggacaacaatggacagcattgctggaacaacttaccctaggtgcatgatgcatccaagctttgctggcataattgatcttgagcttccaaacaacactggtgctatgcttgctgacgcacatgggctgttcatgctggagttctcaaagaccatcaatccatctctgaggaccaagcagccaaatgagattgcagcgacatttgagaaacccaacatggctgccatgactggacgtttcttcactagagatgataagaagaagctgctcattgctatcggggttctcgatgaagacctggtgccaaatccagccattgagaagtgtgctgagaagtacaaggccaaggttgggaagtga

SEQ ID NO: 3202 - RNA, 762 nt, synthetic construct
  misc_feature 1..762: note = derived and/or modified CDS sequence (wt) from Naples virus(Yu 8/76)__JF920141.1__N
  source 1..762: mol_type = other RNA
atgtctgaggacgactatcataagattgctttggcctttgccgaagagtcagctgacgtcagcaccattgaaagctgggttaatgattttgcgtaccaaggatttgatccaagacgtatagtccagctggttaaggaaagagggactgccaaaggcagagattggaagaaagatgttaagatgatgattgttctcaatctagtgagggggaacaagccagaagcgatgatgaaaaagatgtcagagaaaggtgctgccattgttgcccagcttatctcagtctaccaacttaaagaagggaatcctggaagggacactatcactctctcacgagtctctgctgcttttgtgccatggactgttcaagccctaagagtgctctcagatcacttgcctgtgactggaaccaccatggatgctattgctggggtgacttacccaagagctatgatgcatccaagctttgcaggaatagttgatctggagcttccaaggaagacaggagaaatgattgctgatgctcatggattgttcatgcttgagttctctaagactataaatccgtctctgagaaccaaacagccaaatgagatcgccacaacatttgagaaacccaacatggctgccatgtctgggaaattcttctccagagaagacaagaaaaagcttctcatgtctgtgggcattatcaatgatgacttgcttctgacagctagtgttgtcaagtgtgctgaaaagtacagagccaagacaggtaagtga

SEQ ID NO: 3203 - RNA, 762 nt, synthetic construct
  misc_feature 1..762: note = derived and/or modified CDS sequence (wt) from Punique virus(P1_B4_2008)__FJ848987.1__N
  source 1..762: mol_type = other RNA
atgtctgaggaaaactaccgagagatcgccctagcctttttagacgagtctgcagactctggtactatttcaacctgggttaatgactttgcctaccaaggatttgacccaaagcgcatagtccagttggtgaaggagagaggtactgccaaggggagagactggaaaaaggatgtgaaaatgatgatcgttctgaatctggtcagaggcaacaagccagagagcatgatgaagaagatgtctgagaaaggtgctgcaattgttgctcagttgattgctgcataccagctgaaggagggcaacccaggaagggacacaatcactctttccagagtgtctgctgcttttgtcccttggactgtgcaagctcttaggtctttgtctgactcattgccagtgactgggactaccatggatagcattgctggggtcacttatcccaggtgcatgatgcatcctagctttgctgggattattgaccttgacttgccaaatgacactggggccatgcttgctgatgctcatggtttgttcatgctagagttttcaaagacaataaacccatctttgagaactaagcaggccaatgagattgctgctacctttgagaaaccgaacatggctgccatgaatggcagattcttcacaagggaggataagaagaagctgctcatcgctattggggtcttgaatgaagacctgatccctgtgtctgccattgctaaatgcgcagagaagtacagggccaaggttggaaagtga

SEQ ID NO: 3204 - RNA, 762 nt, synthetic construct
  misc_feature 1..762: note = derived and/or modified CDS sequence (wt) from Saint Floris virus(Dak ANB512)__JF920138.1__N
  source 1..762: mol_type = other RNA
atgtctgaagagacctatgctcaattggctatggcctttttggcagaacctgctgactggtcaaccctttcagtatgggttaatgagtttgcttatcaaggattcgatcccaaaaggattgttgaattgatcatggagagagggaagaaattcaacagagagtggaagaaagatgtgaagatgatgatcactttgaacttgatccgtggaaataagcctgaggccatgatgaggaagatgtcagacaaaggacgttccattgtgtctgaactaatttcagtctatgaactgaaagagggaaacccaggaagagacaccatcactctttctagggtctctgctgcctttgtcccttggactgttagagctcttgtagctctgcagaatgatcttcctgtgactggtgctgcaatggattccatttgtggagtgacttatccaagggccatgatgcatccaagctttgctggagtcatcgaccttgagctccccaatggtgttggagcccagctggctgatgctcatggactattcatgcttgagttttccaagacaatcaaccctggtttaagaactaagcagcctaatgagatagcagcaacgtttgaaaagccaaatcttgctgccatgactggaaagttcttcaccaaggaagacaagcgcaaagtcctcatcagtgttggtgtcatcaattcagacttgcagcccaacagtgttgtcaaaacatgtgctgagctgtacagagcaagagtgatgaaatga

SEQ ID NO: 3205 - RNA, 762 nt, synthetic construct
  misc_feature 1..762: note = derived and/or modified CDS sequence (wt) from Tehran virus(I-47)__JF939848.1__N
  source 1..762: mol_type = other RNA
atgtctgaggaagactaccgtgcgatcgccctatccttttctgacgagtctgcagatgttggcatcataactacatgggtcaatgagtttgcttaccaaggatttgatcctaaaaggattgtccagctcgtcaaggaaagaggacaggcaaaaggaagagactggaagaaggatgtgaaaatgatgattgttttgaacttgatcagaggaaacaagcctgatgccatgatgaagaaaatgtcagagaagggagctgccactgttgcccagttggtctctgtctatcagctaaaagaagggaatcctggtagggacaccatcactctctccagagtttctgctgcttttgtaccttggactgtgcaagctttgaaggttttgtctgagtctcttcctgtgacaggcacaaccatggacactgttgctggggtaacttatccaagagccatgatgcatccgagcttcgctggaatcattgatctggaacttccagggagagctggagaagctattgctgatgcccatggactcttcatgctagagttctctaaaaccatcaatccatctttgagaaccaagcagcctaatgagattgcagcaacttttgaaaagccaaacatggctgccatgacaggaagatttttcaccagagaggacaagaagaagctcctcattgctgtggggattatcaatgatgatctactgctaactccttctattgctaaatgtgctgaaaaatatagggctaaggttggaaagtga

SEQ ID NO: 3206 - RNA, 762 nt, synthetic construct
  misc_feature 1..762: note = derived and/or modified CDS sequence (wt) from Zerdali virus(37)__KP966618.1__N
  source 1..762: mol_type = other RNA
atgtctgaggaagactaccgagcgatcgccctatccttttccgatgaggcagcagatgttggcactatcacagcatgggtgaatgagtttgcttatcagggttttgacccaaagcgtattgttcaacttgtgagggagagagggattgcaaaggggagagattggaagaaggatgttaagatgatgattgtcttgaatttgatccgaggcaataaacctgatgccatgatgaagaagatgtcagaaaagggagcagctactgtggctcagctggtgtctgtttatcaacttaaagaaggaaatcctgggagagataccatcactccctccagagtttctgctgcttttgttccttggacagtccaagctctcaaggttttgtctgagtcacttcctgttactggaacaacaatggacaccattgctggggtctcttatccaagagcaatgatgcatcctagttttgcaggaattattgatctggagcttccaagaagagctggagaagttattgcagatgctcatggactgttcatgttggaattttcgaagacaatcaatccttctctcaggaccaagcagcccaatgagattgctgccacttttgagaagcccaacatggctgctatgacaggcaggttcttcactagagaggacaagaaaaagctccttattgctgttgggataattaatgatgatctcctcctggcaccatcagtggccaagtgtgctgagaagtacagagccaaggttgggaaatga

SEQ ID NO: 3207 - RNA, 762 nt, synthetic construct
  misc_feature 1..762: note = derived and/or modified CDS sequence (wt) from TOSV(9028)__KU904263.1__N
  source 1..762: mol_type = other RNA
atgtcagacgagaattatcgcgacattgctcttgcttttcttgatgagtctgcagattctgggaccatcaatgcatgggtgaatgagtttgcttaccaagggtttgacccaaagcgcattgtccaactggttaaggagagaggaacagcaaagggcagggactggaagaaggacgtgaagatgatgattgtgctgaaccttgtcagagggaataagcctgaggctatgatgaagaagatgtcagagaagggtgcgtctatagtggccaatctgatatcagtgtaccagctgaaggagggaaatcctggcagagacaccatcactctgtctagagtgtcggctgcttttgttccatggaccgttcaggcacttcgcgttctgtcagaatcgctgccagtttctgggaccactatggatgccattgccggcgtgacctacccaagagccatgatgcaccccagctttgctgggattattgacctagatctgccaaatggagctggggccaccattgctgatgctcatggattgttcatgattgagttctctaagacaataaacccatctttgagaactaagcaggctaatgaggtggctgctacgtttgaaaagcccaacatggctgccatgagtggacggttcttcactagggaggacaaaaagaagctactcatagcagtcggaattattgatgaggacctggttttggcatcagcagtggtgagaagcgcagagaagtatcgggccaaggtgggtaagtaa

SEQ ID NO: 3208 - RNA, 762 nt, synthetic construct
  misc_feature 1..762: note = derived and/or modified CDS sequence (wt) from TOSV(SI-121283)__JF330274.1__N
  source 1..762: mol_type = other RNA
atgtcagacgagaattatcgcgacattgctcttgcttttcttgatgagtctgcagattctgggaccatcaatgcatgggtgaatgagtttgcttatcaagggtttgacccaaagcgcattgttcagttggtcaaggagagaggaacggcaaagggcagggactggaagaaagatgtgaagatgatgattgtgctgaaccttgttaggggaaacaagccagaggccatgatgaagaagatgtcagagaagggtgcttctattgtggccaacctgatttcagtctatcagctgaaagaagggaaccctggcagggacaccatcactctgtcaagggtatcagccgcatttgttccgtggactgttcaggcactacgtgtcctgtcagaatccctgcctgtgtctggaaccaccatggatgccattgctggtgtgacctacccaagagccatgatgcatcctagcttcgctggaatcattgatctggaccttccgaatggggctggggccaccattgctgatgctcatgggctattcatgattgagttctcaaagaccataaatccatctctgagaacaaaacaggctaatgaagtggctgccacatttgaaaaccccaacatggccgccatgagtggacggttcttcaccagagaagataagaagaagctgctcatagcagtggggatcattgatgaggatcttgttctggcgtctgcagtggtgaggagtgctgagaagtatcgcgctaaggttggcaagtga

SEQ ID NO: 3209 - RNA, 762 nt, synthetic construct
  misc_feature 1..762: note = derived and/or modified CDS sequence (wt) from TOSV(5963930705)__KU935733.1__N
  source 1..762: mol_type = other RNA
atgtcagacgagaattatcgcgacattgctcttgcttttcttgatgagtctgcagattctgggaccatcaatgcatgggtgaatgagtttgcttaccaagggtttgacccaaagcgcattgtccaactggttaaggagagaggaacagcaaagggcagggactggaagaaggacgtgaagatgatgattgtgctgaaccttgttagagggaataagcctgaggctatgatgaagaagatgtcagagaagggtgcatccatagtggccaatctgatatcagtgtaccagctgaaggagggaaatcctggcagagacaccatcactctgtctagagtgtcggctgcttttgttccatggaccgttcaggcacttcgcgttctgtcagaatcgctgccagtttctgggaccactatggatgccattgccggcgtgacctacccaagagccatgatgcaccccagctttgctgggattattgacctagatctgccaaatggagctggggccaccattgctgatgctcatggattgttcatggttgagttctctaagacaataaacccatctttgagaactaagcaggctaatgaggtggctgctacgtttgaaaagcccaacatggctgccatgagtggacggttcttcactagggaggacaaaaagaagctgctcatagcagtcggaattattgatgaggacctggttttggcatcagcagtagtgagaagcgcagagaagtatcgggccaaggtgggtaagtaa

SEQ ID NO: 3210 - RNA, 762 nt, synthetic construct
  misc_feature 1..762: note = derived and/or modified CDS sequence (wt) from TOSV(MRS2010-4319501)__KC776214.1__N
  source 1..762: mol_type = other RNA
atgtcagacgagaattatcgcgacattgctcttgcttttcttgatgagtctgcagattctgggaccatcaatgcatgggtgaatgagtttgcttaccaagggtttgacccaaagcgcattgtccaactggttaaggagagaggaacagcaaagggcagggactggaagaaggacgtgaagatgatgattgtgctgaaccttgtcagagggaataagcctgaggctatgatgaagaagatgtcagagaagggtgcgtcaatagtggccaatctgatatcagtgtaccagctgaaggagggaaaccctggcagagacaccatcactctgtctagagtgtcggctgcttttgttccatggaccgttcaggcacttcgcgttctgtcagaatcgctgcctgtttctgggaccactatggatgccattgccggcgtgacttacccaagagccatgatgcaccccagctttgctgggattattgacctccacctgccaaatggagctggggccaccattgctgatgctcatggattgttcatgattgagttctctaagacaataaacccatctttgagaactaagcaggctaatgaggtggctgctacgtttgaaaagcccaacatggctgccatgagtggacggttcttcactagggaggacaaaaagaagctactcatagcagtcggaattattgatgaggacctggttttggcatcagcagtagtgagaagcgcagagaagtatcgggccaaggtgggtaagtaa

SEQ ID NO: 3211 - RNA, 762 nt, synthetic construct
  misc_feature 1..762: note = derived and/or modified CDS sequence (wt) from TOSV(TOSV/Firenze.ITA/1983/2)__KM275765.1__N
  source 1..762: mol_type = other RNA
atgtcagacgagaattatcgcgatattgctcttgcttttcttgatgagtgtgcagattctgggaccatcaatgcatgggtgaatgagtttgcttaccaagggtttgacccaaagcgcattgttcagttggtcaaggagagaggaacagcaaagggcagggattggaagaaagatgtgaagatgatgattgtgctgaaccttgtcagggggaacaagccagaggccatgatgaagaaaatgtcagagaagggtgcttctattgtggccaacttgatttcagtctatcagctgaaagaagggaaccctggcagggacactatcactctgtcaagggtgtcagctgcatttgttccgtggactgttcaggcactacgtgtcctgtcagaatccctgcccgtttctgggaccaccatggatgccattgctggtgtgacctacccaagagccatgatgcaccctagctttgctggaatcattgatctggaccttccaaatggagctggggccactattgctgatgctcatgggctattcatgattgagttctcaaagaccataaatccatctctgagaacaaaacaggctaatgaagtggctgccacatttgaaaagcccaatatggccgccatgagtggacgattcttcactagggaggacaagaaaaagctgctcatagcagtggggatcattgacgaggatcttgttctggcgtctgcagtggtgaggagtgctgagaagtatcgtgctaaggttggcaagtga

SEQ ID NO: 3212 - RNA, 738 nt, synthetic construct
  misc_feature 1..738: note = derived and/or modified CDS sequence (wt) from SFTSV(HB29)__NC_018137.1__N
  source 1..738: mol_type = other RNA
atgtcggagtggtccaggattgcagtggagtttggtgagcagcagctcaatttgactgagcttgaggacttcgcgagagagctggcctatgaaggccttgaccctgctttgatcatcaagaagctgaaggagacaggtggagatgattgggtgaaggatacaaagttcatcattgtctttgccctgactcgaggcaataagatcgtcaaggcatcagggaaaatgtcaaactcagggtccaagaggttgatggcactccaagagaaatatggactggttgagagggcagagaccaggctctcaatcactccagtgagggttgcgcagagccttcccacttggacatgtgctgctgcagcagctctaaaggagtatctcccagtagggccagccgtcatgaacctgaaggttgagaattatccccctgagatgatgtgcatggcctttggatccctgattccaactgcgggggtatctgaagccacaaccaagaccctgatggaggcctactctctgtggcaagatgccttcaccaagactatcaatgtaaagatgcgcggagccagcaagacagaagtttacaactccttcagggaccctcttcatgctgctgtgaactctgtcttctttcccaatgatgttcgggtaaagtggctgaaggccaaggggatccttggcccagatggggtccccagcagagctgctgaggttgctgctgctgcttacagaaacctgtaa

SEQ ID NO: 3213 - RNA, 738 nt, synthetic construct
  misc_feature 1..738: note = derived and/or modified CDS sequence (wt) from SFTSV(111S)__KP339904.1__N
  source 1..738: mol_type = other RNA
atgtcagagtggtccaggattgcagtggagtttggtgagcagcagctcaatttgactgagcttgaggatttcgcgagagagctagcctatgaaggccttgatcgtgctttgatcatcaagaagctgaaggagacaggtggagatgactgggtgaaggatactaagttcatcattgtctttgccctgactcgaggcaataagatcgtcaaggcatcagggaagatgtcaaactcagggtcaaagaggttgatggcactccaggagaaatatgggctggttgagagggcagagaccaggctctcaatcacccctgtaagggtagcgcagagcctccccacttggacatgtgctgcagcagcagccttaaaggagtatctcccagtggggccagccgtcatgaacctgaaggttgagaattatccccctgagatgatgtgcatggccttcgggtccctgattccaactgcaggggtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3214 - RNA, 738 nt, synthetic construct
  misc_feature 1..738: note = derived and/or modified CDS sequence (wt) from SFTSV(116S)__KP339905.1__N
  source 1..738: mol_type = other RNA
atgtcagagtggtccaggattgctgtggagtttggtgagcagcagctcaatttgactgagcttgaggatttcgcgagagagctagcctatgaaggccttgaccctgctttgatcatcaagaagctgaaggagacaggtggagatgactgggtgaaggatactaagttcatcattgtctttgccctgacgcgaggcaataagatcgtcaaggcatcagggaagatgtcaaactcagggtcaaagaggttgatggcactccaggagaaatatgggctggttgagagggcagagaccaggctctcaatcacccctgtaagggtagcgcagagcctccccacttggacatgtgctgcagcagcagccttaaaggagtatctcccagtggggccagccgtcatgaacctgaaggttgagaattatccccctgagatgatgtgcatggccttcgggtccctgattccaactgcaggggtatctgaagccacgaccaagaccctgatggaggcttactctttatggcaagatgccttcaccaagactatcaatgtgaagatgcgcggagccagcaagacagaaatttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3215 - RNA, 738 nt, synthetic construct
  misc_feature 1..738: note = derived and/or modified CDS sequence (wt) from SFTSV(132S)__KP339912.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgatcatcaagaagctgaaggagacaggtggagatgattgggtgaaggatacgaagttcatcagtgtctttgccctaactcgaggcaataagatcgtcaaggcatcagggaaaatgtctaactcagggtctaagaggttgatggcactccaagagaagtatggactggttgagagggcagaaaccaggctctcaatcactcctgtgagggtagcgcagagtcttcccacctggacatgtgcagcagcagcagccttaaaggagtatctcccagtggggccagccgtcatgaacctgaaggttgagaattatccccctgagatgatgtgcatggcctttggatccctaattccaactgcgggggtatctgaagccacaaccaagaccctcatggaggcttactctctgtggcaagatgccttcaccaagactatcaatgtgaagatgcgtggagccagcaagacagaagtttataactccttcagggaccctctccatgctgctgtgaactctgtcttctttcccaatgatgttcgggtgaagtggctgaaggccaagggaatccttggaccagatggggttcccagcagagctgctgaggttgctgctgctgcttacagaaacctgtaa

SEQ ID NO: 3216 - RNA, 738 nt, synthetic construct
  misc_feature 1..738: note = derived and/or modified CDS sequence (wt) from SFTSV(2014045S)__KR075923.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgatcatcaagaagctgaaggagacaggtggagatgattgggtgaaggatacgaagttcatcattgtctttgccctaactcgaggcaataagatcgtcaaggcatcagggaaaatgtctaactcagggtctaagaggttgatggcactccaagagaagtatggactggttgagagggcagaaaccaggctctcaatcactcctgtgagggtagcgcagagtcttcccacctggacatgtgcagcagcagcagccttaaaggagtatctcccagtggggccagccgtcatgaacctgaaggttgagaattatccccctgagatgatgtgcatggcctttggatccctaattccaactgcgggggtatctgaagccacaaccaagaccctcatggaggcttactctctgtggcaagatgccttcaccaaaactatcaatgtgaagatgcgtggagccagcaagacagaagtttataactccttcagggaccctctccatgctgctgtgaactctgtcttctttcccaatgatgttcgggtgaagtggctgaaggccaagggaatccttggaccagatggggctcccagcagagctgctgaggttgctgctgctgcttacagaaacctgtaa

SEQ ID NO: 3217 - RNA, 738 nt, synthetic construct
  misc_feature 1..738: note = derived and/or modified CDS sequence (wt) from SFTSV(2014193S)__KR075916.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgatcatcaagaagctgaaggagacaggtggagatgattgggtgaaggatacgaagttcatcattgtctttgccctgactcgaggcaataagatcgtcaaggcatcagggaaaatgtctaactcagggtctaagaggttgatggcactccaagagaagtatggactggttgagagggcagaaaccaggctctcagtcactcctgtgagggtagcgcagagtcttcccacctggacatgtgcagcagcagcagccttaaaggagtatctcccagtggggccagccgtcatgaacctgaaggttgagaattatccccctgagatgatgtgcatggcctttggatccctaattccaactgcgggggtatctgaagccacaaccaagacccttatggaggcttattctttgtggcaagatgccttcaccaagactatcaatgtgaagatgcgtggagccagcaagacagaagtttataactccttcagggaccctctccatgctgctgtgaactctgtcttctttcccaatgatgttcgggtgaagtggctgaaggccaagggaatccttggcccagatggggttcccagcagagctgctgaggttgctgctgctgcttacagaaacctgtaa

SEQ ID NO: 3218 - RNA, 738 nt, synthetic construct
  misc_feature 1..738: note = derived and/or modified CDS sequence (wt) from SFTSV(2015SH232S)__KT736097.1__N
  source 1..738: mol_type = other RNA
atgtcggagtggtccaggattgcagtggagtttggtgagcagcagctcaatttgactgagcttgaggacttcgcgagagagctggcctatgaaggccttgaccctgctttgatcatcaagaagctgaaggagacaggtggagatgattgggtgaaggatacaaagttcatcattgtctttgccctgactcgaggcaataagatcgtcaaggcatcagggaaaatgtcaaactcagggtccaagaggttgatggcactccaagagaaatatggactggttgagagggcagagaccaggctctcaatcactccagtgagggttgcgcagagccttcccacttggacatgtgctgctgcagcagctctaaaggagtatctcccagtagggccagccgtcatgaacctgaaggttgagaattatccccctgagatgatgtgcatggcctttggatccctgattccaactgcgggggtatctgaagccacaaccaagaccctgatggaggcctactctctgtggcaagatgccttcaccaagactatcaatgtgaagatgcgcggagccagcaagacagaagtttacaactccttcagggaccctcttcatgctgctgtgaactctgtcttctttcccaatgatgttcgggtaaggtggctgaaggccaaggggatccttggcccagatggggtccccagcagagctgctgaggttgctgctgctgcttacagaaacctgtaa

SEQ ID NO: 3219 - RNA, 738 nt, synthetic construct
  misc_feature 1..738: note = derived and/or modified CDS sequence (wt) from SFTSV(2015SYSH33)__KT380653.1__N
  source 1..738: mol_type = other RNA
atgtcagagtggtccagaattgcagtggagtttggtgagcagcagctcaatttgactgagcttgaggatttcgcgagagagctagcctatgaaggccttgatcctgctctgatcatcaagaagctgaaggagacaggtggagatgactgggtgaaggatactaagttcatcattgtctttgccctgactcgaggcaataagatcgtcaaggcatcagggaagatgtcaaactcagggtctaagaggttgatggcactccaggagaaatatgggctggttgagagggcagagaccaggctctcaatcaccccagtaagggtagcgcagagcctccccacttggacatgtgctgcagcagcagccttaaaggagtatctccctgtggggccagccgtcatgaacctgaaggtcgagaattatccccctgagatgatgtgcatggccttcgggtccctgattccaactgcaggagtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgttttcttccccaatgatgttcgggtgaagtggctgaaggccaagggaatccttggcccagatggggtccccagcagagctgctgaggttgctgctgctgcttacaggaacctgtaa

SEQ ID NO: 3220 - RNA, 738 nt, synthetic construct
  misc_feature 1..738: note = derived and/or modified CDS sequence (wt) from SFTSV(2015SYSH86)__KT380657.1__N
  source 1..738: mol_type = other RNA
atgtcagagtggtccaggattgcagtggagtttggtgagcagcagctcaatttgactgagcttgaggatttcgcgagagagctagcctatgaaggccttgatcctgctttgatcatcaagaagctgaaggagacaggtggagatgactgggtgaaggatactaagttcatcattgtctttgccctgactcgaggcaataagatcatcaaggcatcagggaagatgtcaaactcagggtcaaagaggttgatggcactccaggagaaatatgggctggttgagagggcagagaccaggctctcaatcacccctgtaagggtagcgcagagcctccccacttggacatgtgctgcagcagcagccttaaaggagtatctcccagtggggccagccgtcatgaacctgaaggttgagaattatccccctgagatgatgtgcatggccttcgggtccctgattccaactgcaggggtatctgaagctacgaccaagaccctgatggaggcttactctttatggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3221 - RNA, 738 nt, synthetic construct
  misc_feature 1..738: note = derived and/or modified CDS sequence (wt) from SFTSV(67S)__KP339890.1__N
  source 1..738: mol_type = other RNA
atgtcagagtggtccaggattgcagtggagtttgctgagcagcagctcaatttgactgagcttgaggatttcgcgagagagctagcctatgaaggccttgatcctgctttgatcatcaagaagctgaaggagacaggtggagatgactgggtgaaggatactaagttcatcattgtctttgccctgactcgaggcaataagatcgtcaaggcatcagggaagatgtcaaactcagggtcaaagaggttgatggcactccaggagaaatatgggctggttgagagggcagagaccaggctctcaatcacccctgtaagggtagcgcagagcctccccacttggacatgtgctgcagcagcagccttaaaggagtatctcccagtggggccagccgtcatgaacctgaaggttgagaattatccccctgagatgatgtgcatggccttcgggtccctgatcccaactgcaggggtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3222 - RNA, 738 nt, synthetic construct
  misc_feature 1..738: note = derived and/or modified CDS sequence (wt) from SFTSV(6S)__KP339927.1__N
  source 1..738: mol_type = other RNA
atgtcagagtggtccagaattgcagtggagtttggtgagcagcagctcaatttgactgagcttgaggatttcgcgagagagctagcctatgaaggccttgatcctgctctgatcatcaagaagctgaaggagacaggtggagatgactgggtgaaggatactaagttcatcattgtctttgccctgactcgaggcaataagatcgtcaaggcatcagggaagatgtcaaactcagggtctaagaggttgatggcactccaggagaaatatgggctggttgagagggcagagaccaggttctcaatcaccccagtaagggtagcgcagagcctccccacttggacatgtgctgcagcagcagccttaaaggagtatctccctgtggggccagccgtcatgaacctgaaggtcgagaattatccccctgagatgatgtgcatggccttcgggtccctgattccaactgcaggggtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgttttcttccccaatgatgttcgggtgaagtggctgaaggccaagggaatccttggcccagatggggtccccagcagagctgctgaggttgctgctgctgcttacaggaacctgtaa

SEQ ID NO: 3223 - RNA, 738 nt, synthetic construct
  misc_feature 1..738: note = derived and/or modified CDS sequence (wt) from SFTSV(72S)__KP339891.1__N
  source 1..738: mol_type = other RNA
atgtcagagtggtccaggattgcagtggagtttggtgagcagcagctcactttgactgagcttgaggacttcgcgagagagctggcctatgaaggccttgaccctgctttgatcatcaagaagctgaaggagacaggtggagatgattgggtgaaggatacaaagttcatcattgtctttgccctgactcgaggcaataagatcgtcaaggcatcagggaaaatgtcaaactcagggtccaagaggttgatggcactccaagagaaatatggactggttgagagggcagagaccaggctctcaatcactccagtgagggttgcgcagagccttcccacttggacatgtgctgctgcagcagctctaaaggagtatctcccagtagggccagccgtcatgaacctgaaggttgagaattatccccctgagatgatgtgcatggcctttggatccctgattccaactgcgggggtatctgaagccacaaccaagaccctgatggaggcctactctctgtggcaagatgccttcaccaagactatcaatgtgaagatgcgcggagccagcaagacagaagtttacaactccttcagggaccctcttcatgctgctgtgaactctgtcttctttcccaatgatgttcgggtaaggtggctgaaggccaaggggatccttggcccagatggggtccccagcagagctgctgaggttgctgctgctgcttacagaaacctgtaa

SEQ ID NO: 3224 - RNA, 738 nt, synthetic construct
  misc_feature 1..738: note = derived and/or modified CDS sequence (wt) from SFTSV(AP01-Korea-13)__KR612072.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgataatcaagaagctgaaggagacaggtggagatgattgggtgagagatacaaagttcatcattgtctttgccttgacccgaggcaacaagatcgtcaaggcatcggggaaaatgtcaaactctgggtccaagaggttgatggcactccaagagaaatatgggctggttgagagggcagaaaccaggctctcaatcactcctgtgagggttgcgcagagccttcccacttggacatgtgctgcagcagcagccctaaaggagtatctcccagtggggccagctgtcatgaacctgaaggttgagaattatccccctgagatgatgtgcatggcctttgggtccctgatcccaactgcaggagtatctgaagccacaacgaagaccctgatggaggcctactctctgtggcaagatgccttcaccaagactatcaatgtgaagatgcgcggagctagcaagacagaggtttacaactctttcagggatcctctccatgctgctgtgaactctgtcttctttcccaatgatgttcgggtgaagtggctgaaggccaagggaatccttggcccagatggggtccccagcagagctgctgaggttgctgccgctgcttacagaaacctgtaa

SEQ ID NO: 3225 - RNA, 738 nt, synthetic construct
  misc_feature 1..738: note = derived and/or modified CDS sequence (wt) from SFTSV(JP03-Korea-13)__KR612079.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgataatcaagaagctgaaggagacaggtggagatgattgggtgagagatacaaagttcatcattgtctttgccttgacccgaggcaacaagatcgtcaaggcatcagggaaaatgtcaaactcagggtctaagaggttgatggcacttcaagagaaatatggactggttgagagggcagaaaccaggctctcaatcactcctgtgagggtagcacagagccttcctacttggacatgtgctgcagctgcagccttaaaggagtatctcccagtgggcccagctgtcatgaacctgaaggtcgagaattaccccccagagatgatgtgcatggcctttgggtccctgattccaactgcaggggtgtcagaagccacaacgaagaccctgatggaggcctactctctgtggcaagatgccttcaccaagactatcaatgtgaagatgcgtggagccagcaagacagaggtttacaactccttcagggatcctctccatgctgctgtgaactctgtcttctttcccaatgatgttcgggtgaagtggctgaaggccaagggaatccttggcccagatgggatccccagcagagctgctgaggttgctgctgctgcttacagaaacctgtaa

SEQ ID NO: 3226 - RNA, 738 nt, synthetic construct
  misc_feature 1..738: note = derived and/or modified CDS sequence (wt) from SFTSV(JP07-Korea-13)__KR612088.1__N
  source 1..738: mol_type = other RNA
atgtcagagtggtccaggattgcagtggagtttggtgagcatcagctcaatttgactgagcttgaggatttcgcgagagagctggcctatgaaggccttgatcctgctttgataatcaagaagctgaaggagacaggtggagatgattgggtgagagatacaaagttcatcattgtctttgccttgacccgaggcaataagatcgtcaaggcatcagggaaaatgtcaaactcagggtctaagaggttgatggcacttcaagagaaatatggactggttgagagggcagaaaccaggctctcaatcactcctgtgagggtagcacagagccttcctacttggacatgtgctgcagctgcagccttaaaggagtatctcccagtgggcccagctgtcatgaacctgaaggtcgagaattaccccccagagatgatgtgcatggcctttgggtccctgattccaactgcaggggtgtcagaagccacaacgaagaccctgatggaggcctactctctgtggcaagatgccttcaccaagactatcaatgtgaagatgcgtggagccagcaagacagaggtttacaactccttcagggatcctctccatgctgctgtgaactctgtcttctttcccaatgatgttcgggtgaagtggctgaaggccaagggaatccttggcccagatggggtccccagcagagctgctgaggttgctgctgctgcttacagaaacctgtaa

SEQ ID NO: 3227 - RNA, 738 nt, synthetic construct
  misc_feature 1..738: note = derived and/or modified CDS sequence (wt) from SFTSV(JS2011-13-2)__KR230790.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctctgatcatcaagaagctgaaggagacaggtggagatgattgggtgaaggacacgaagttcatcattgtctttgccctgactcgaggcaataagatcgtcaaggcatcagggaaaatgtcaagctcagggtctaagaggttgatggcactccaagagaaatatggactggttgagagggcagaaaccaggctctcaatcactcctgtgagggtagcgcagagccttcccacctggacatgtgcagcagcagcagccttaaaggagtatctcccagtggggccagccgtcatgaacctgaaggttgagaattatccccctgaaatgatgtgcatggcctttggatccctgattccaactgcgggggtatctgaagccacgaccaagaccctgatggaggcctactctctgtggcaagatgccttcaccaagaccatcaatgtgaagatgcgtggagccagcaagacagaagtttacaactccttcagggaccctctccatgctgctgtgaactctgtcttctttcccaatgatgttcgggtgaagtggctaaaggccaagggaatccttggcccagatggggtccccagcagagctgctgaggttgctgctgctgcttacagaaacctgtaa

SEQ ID NO: 3228 - RNA, 738 nt, synthetic construct
  misc_feature 1..738: note = derived and/or modified CDS sequence (wt) from SFTSV(JS2014-15)__KR230799.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctctgatcatcaagaagctgaaggagacaggtggagatgattgggtgaaggatacgaagttcatcattgtctttgccctgactcgaggcaataagatcgtcaaggcatcagggaaaatgtcaaactcagggtctaagaggttgatggcactccaagagaaatatggactggttgagagggcagaaaccaggctctcaatcactcctgtgagggtagcgcagagccttcccacctggacatgtgctgcagcagcagccttgaaggagtatctcctcgtggggccagccgtcatgaacctgaaggttgagaattatccccctgaaatgatgtgcatggcctttggatccctgattccaactgcgggggtatctgaagccacgaccaagaccctgatggaggcctactctctgtggcaagatgccttcaccaagaccatcaatgtgaagatgcgtggagccagcaagacagaagtttacaactccttcagggaccctctccatgctgctgtgaactctgtcttctttcccaatgatgtccgggtgaagtggctaaaggccaagggaatccttggcccagatggggtccccagcagagctgctgaggttgctgctgctgcttacagaaacctgtaa

SEQ ID NO: 3229 - RNA, 738 nt, synthetic construct
  misc_feature 1..738: note = derived and/or modified CDS sequence (wt) from SFTSV(KASJH)__KP663733.1__N
  source 1..738: mol_type = other RNA
atgtcggagtggtccaggattgcagtggagtttggtgagcagcagctcaatttgtctgagcttgaggatttcgcgagagaactggcctatgaaggccttgaccctgctttgatcatcaagaagctgaaggagacaggtggagatgattgggtgaaggatacaaagttcatcattgtctttgccctgactcgaggcaacaagatcgtcaaggcatcagggaaaatgtcaaactcagggtccaagaggttgatggcactccaagagaaatatggactggttgagagggcagagaccaggctctcaatcactcctgtgagggttgcgcagagccttcccacttggacatgtgctgcagcagcagccttgaaggagtatctccctgtggggccagccgtcatgaacctgaaggtcgagaattatccccctgagatgatgtgcatggcctttggatccctgattccaactgcgggggtatctgaagccacaaccaagaccctgatggaggcctactctctgtggcaagatgccttcaccaagactatcaatgtgaagatgcgcggagccagcaagacagaagtttacaactccttcagggaccctcttcatgctgctgtgaactctgtcttctttcccaatgatgttcgggtaaagtggctgaaggccaaggggatccttggcccagatggggtccccagcagagctgctgaggttgctgctgctgcttacagaaacctgtaa

SEQ ID NO: 3230 - RNA, 738 nt, synthetic construct
  misc_feature 1..738: note = derived and/or modified CDS sequence (wt) from SFTSV(YSH116)__KT721303.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgatcatcaagaagctgaaggagacaggtggagatgattgggtgaaggatacgaagttcatcattgtctttgccctaactcgaggcaataagatcgtcaaggcatcagggaaaatgtctaactcagggtctaagaggctgatggcactccaagagaagtatggactggttgagagggcagaaaccaggctctcaatcactcctgtgagggtagcgcagagtcttcccacctggacatgtgcagcagcagcagccttaaaggagtatctcccagtggggccagccgtcatgaacctgaaggttgagaattatccccctgagatgatgtgcatggcctttggatccctaattccaactgcgggggtatctgaagccacaaccaagacccttatggaggcttactctctgtggcaagatgtcttcaccaagactatcaatgtgaagatgcgtggagccagcaagacagaagtttataactccttcagggaccctctccatgctgctgtgaactctgtcttctttcccaatgatgttcgggtgaagtggctgaaggccaagggaatccttggcccagatggggttcccagcagagctgctgaggttgctgctgctgcttacagaaacctgtaa

SEQ ID NO: 3231 - RNA, 738 nt, synthetic construct
  misc_feature 1..738: note = derived and/or modified CDS sequence (wt) from SFTSV(AH-YTY/China/05/2012)__KR017811.1__N
  source 1..738: mol_type = other RNA
atgtcagagtggtccaggattgcagtggagtttggtgagcagcagctcaatttgactgagcttgaggattttgcgagagagctggcctatgaaggccttgatcctgctttgatcatcaagaagctgaaggagacaggtggagatgactgggtgaaggacaccaagttcatcattgtctttgccctgactcgaggcaataagatcgtcaaggcatcagggaagatgtcaaactcagggtctaagaggttgatggcgctccaggagaaatatggactggttgagagggcagagaccaggctctcaatcacccctgtaagggtagcgcagagcctccccacttggacatgtgctgcagcagcagccttaaaggagtatctcccagtggggccagccgtcatgaacctgaaggtcgagaattatccccctgagatgatgtgcatggccttcgggtccctgattccaactacaggggtatctgaagccacgaccaagaccctgatggaggcttactctttgtggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3232 - RNA, 738 nt, synthetic construct
  misc_feature 1..738: note = derived and/or modified CDS sequence (wt) from SFTSV(DS02/CHN/2013)__KR698319.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgataatcaagaagctgaaggagacaggtggagatgattgggtgagagatacaaagttcatcattgtctttgccttgacccgaggcaataagatcgtcaaggcttcagggaaaatgtcaaactcagggtccaagaggctgatggcacttcaagagaaatatggactggttgagaaggcagaaaccaggctctcaatcacccctgtgagggtagcacagagccttcccacttggacatgtgctgcagcagcagccttaaaggagtatctcccagtgggcccagctgtcatgaacctgaaggtcgagaattaccccccagagatgatgtgcatggcctttgggtccctgattccaactgcaggggtatcagaggccacaacgaagaccctgatggaggcctactctctgtggcaagatgccttcaccaagactatcaatgtgaagatgcgtggagccagcaagacagaggtttacaactccttcagggatcctctccatgcagctgtgaactctgtcttctttcccaatgatgttcgggtgaagtggctgaaggccaaggggatccttggcccagatggggtccccagcagagctgctgaggttgctgctgctgcttacagaaacctgtaa

SEQ ID NO: 3233 - RNA, 738 nt, synthetic construct
  misc_feature 1..738: note = derived and/or modified CDS sequence (wt) from SFTSV(HB2014-13)__KU738908.1__N
  source 1..738: mol_type = other RNA
atgtcagagtggtccaggattgcagtggagtttggtgagcagcagctcaatttgactgagcttgaggattttgcgagagagctggcctatgaaggccttgatcctgctttgatcatcaagaagctgaaggagacaggtggagatgactgggtgaaggacaccaagttcatcattgtctttgccctgactcgaggcaataagatcgtcaaggcatcagggaagatgtcaaactcagggtctaagaggttgatggcgctccaggagaaatatggactggttgagagggcagagaccaggctctcaatcacccctgtaagggtagcgcagagcctccccacttggacatgtgctgcagcagcagccttaaaggagtatctcccagtggggccagccgtcatgaacctgaaggtcgagaattatccccctgagatgatgtgcatggccttcgggtccctgattccaactacaggggtatctgaagccacgaccaagaccctgatggaggcttactctttgtggcaagatgccttcaccaagactatcaatgtgaagatgcgcggagccagcaagacagaagtttacaactccttcagggatcctctccatgctgctgtgaactctgtcttcttccccaatgatgttcgggtgaggtggctgaaggccaagggaatccttggcccagatggggtccccagcagagctgctgaggttgctgctgctgcttacaggaacctgtaa

SEQ ID NO: 3234 - RNA, 738 nt, synthetic construct
  misc_feature 1..738: note = derived and/or modified CDS sequence (wt) from SFTSV(HB2014-20)__KU738910.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgatcatcaagaagctgaaggagacaggtggagatgattgggtgaaggatacgaagttcatcattgtctttgccctgactcgaggcaataagatcgtcaaggcatcagggaaaatgtctaactcagggtctaagaggttgatgacactccaagagaagtatggactggttgagagggcagaaaccaggctctcaatcactcctgtgagggtagcgcagagtcttcccacctggacatgtgcagcagcagcagccttaaaggagtatctcccagtggggccagccgtcatgaacctgaaggttgagaattatccccctgagatgatgtgcatggcctttggatccctaattcctactgcgggggtatctgaagccacaaccaagacccttatggaggcttactctctgtggcaagatgccttcaccaagactatcaatgtgaagatgcgtggagccagcaagacagaagtttataactccttcagggaccctctccatgctgctgtgaactctgtcttctttcccaatgatgttcgggtgaagtggctgaaggccaagggaatccttggcccagatggggttcccagcagagctgctgaggttgctgctgctgcttacagaaacctgtaa

SEQ ID NO: 3235 - RNA, 738 nt, synthetic construct
  misc_feature 1..738: note = derived and/or modified CDS sequence (wt) from SFTSV(LN2012-14)__KF887431.1__N
  source 1..738: mol_type = other RNA
atgtcggagcggtccaggattgcagtggagtttggtgagcagcagctcaatttgactgggcttgaggatttcgcgagagagctggcctatgaaggcctagaccctgctttgatcatcaagaagctgaaagagacaggtggagacgattgggtgaaggatacaaagttcatcattgtctttgccctgactcgaggcaataagatcgtcaaggcatcagggaaaatgtcaaactcagggtccaagaggttgatggcactccaagagaaatatggactggttgagagggcagagaccaggctctcaatcactcctgtgagggttgcgcagagcctgcccacttggacatgtgctgcagcagcagccttaaaagagtatctcccagtggggccagctgtcatgaacctgaaggtcgagaattatccccctgagatgatgtgcatggcctttggatccctgattccaactgcgggggtgtctgaagccacaaccaggaccctgatggaggcctactctctgtggcaggatgccttcaccaagactatcaatgtgaagatgcgcggagccagcaagacagaagtttacaactccttcagggaccctcttcatgctgctgtgaactctgtcttctttcccaatgatgttcgggtaaagtggctgaaggccaagggaatccttggaccagatggggtccccagcagagctgctgaggttgctgctgctgcttacagaaacctgtaa

SEQ ID NO: 3236 - RNA, 738 nt, synthetic construct
  misc_feature 1..738: note = derived and/or modified CDS sequence (wt) from SFTSV(NB31/CHN/2013)__KR698325.1__N
  source 1..738: mol_type = other RNA
atgtcagagtggtccaggattgcagtggagtttggtgagcagcagctcaatttgattgagcttgaggacttcgcgagagagctggcctatgaaggccttgatcctgctctgatcatcaagaagctgaaggagacaggtggagatgattgggtgagggatacaaagttcatcattgtctttgccctgactcgaggcaataagatcgtcaaggcatcagggaaaatgtcaaactcagggtctaagaggttgatggcactccaagagaaatacggactggttgagaaggcagaaaccaggctctcaatcactccggtgagggttgcacagagccttcccacttggacatgtgctgcagcagcagccttaaaggagtaccttccagtggggcctgctgtcatgaacctaaaggtcgagaattatcccccagagatgatgtgcatggcctttggatccctgattccaactgcgggggtatcaaaacccacaacgaaaaccctgatggaggcctactctctgtggcaagatgccttcaccaagactatcaatgtgaagatgcgaggagccagcaagacagaggtttacaactccttcagggatcctctccatgctgctgtgaactctgtcttctttcccaatgacgttcgggtgaagtggctgaaggccaagggaatccttggcccagatggggtccccagcagagctgctgaggttgctgctgctgcttacagaaacctgtaa

SEQ ID NO: 3237 - RNA, 738 nt, synthetic construct
  misc_feature 1..738: note = derived and/or modified CDS sequence (wt) from SFTSV(QD7)__KR706565.1__N
  source 1..738: mol_type = other RNA
atgtcagagtggtccaggattgcagtggagtttggtgtgcagcagctcaatttgactgagcttgaggatttcgcgagagagctagcctatgaaggccttgatcctgctttgatcatcaagaagctgaaggagacaggtggagatgactgggtgaaggatactaagttcatcattgtctttgccctgactcgaggcaataagatcgtcaaggcatcagggaagatgtcaaactcagggtcaaagaggttgatggcactccaggagaaatatgggctggttgagagggcagagaccagactctcaatcacccctgtaagggtagcgcagagcctccccacttggacatgtgctgcagcagcagccttaaaggagtatctcccagtggggccagccgtcatgaacctgaaggtcgagaattatccccctgagatgatgtgcatggccttcgggtccctgattccaactgcaggggtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3238 - RNA, 738 nt, synthetic construct
  misc_feature 1..738: note = derived and/or modified CDS sequence (wt) from SFTSV(SDLZP06/2011)__JQ693009.1__N
  source 1..738: mol_type = other RNA
atgtcagagtggtccaggactgcagtggagtttggtgagcagcagctcaatttgactgagcttgaggatttcgcgagagagctagcctatgaaggccttgatcctgctttgatcatcaagaagctgaaggagacaggtggagatgactgggtgaaggatactaagttcatcattgtctttgccctgactcgaggcaataagatcgtcaaggcatcagggaagatgtcaaactcagggtcaaagaggttgatggcactccaggagaaatatgggctggttgagagggcagagaccaggctctcaatcacccctgtaagggtagcgcagagcctccccacttggacatgtgctgcagcagcagccttaaaggagtatctcccagtggggccagccgtcatgaacctgaaggtcgagaattatccccctgagatgatgtgcatggccttcgggtccctgattccaactgcaggggtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3239 - RNA, 738 nt, synthetic construct
  misc_feature 1..738: note = derived and/or modified CDS sequence (wt) from SFTSV(ZJZHSH-FDE/China/06/2012)__KR017821.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgataatcaagaagctgaaggagacaggtggagatgattgggtgagagatacaaagttcatcattgtctttgccttgacccgaggcaataagatcgtcaaggcttcagggaaaatgtcaaactcagggtccaagaggctgatggcacttcaagagaaatatggactggttgagaaggcagaaaccaggctctcaatcacccctgtgagggtagcacagagccttcccacttggacatgtgctgcagcagcagccttaaaggagtatctcccagtgggcccagctgtcatgaacctgaaggtcgagaattaccccccagagatgatgtgcatggcctttgggtccctgattccaactgcaggggtatcagaggccacaacgaagaccctgatggaggcctactctctgtggcaagatgccttcaccaagactatcaatgtgaagatgcgtggagccagcaagacagaggtttacaactccttcagggatcctctccatgctgctgtgaactctgtcttatttcccaatgatgttcgggtgaagtggctgaaggccaaggggatccttggcccagatggggtccccagcagagctgctgaggttgctgctgctgcttacagaaacctgtaa

SEQ ID NO: 3240 - RNA, 738 nt, synthetic construct
  misc_feature 1..738: note = derived and/or modified CDS sequence (wt) from SFTSV(ZJZHSH-FZHR/China/07/2013)__KR017824.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgatcatcaagaagctgaaggagacaggtggagatgattggatgaaggatacaaagttcatcattgtctttgccctgacccgaggcaacaagatcgtcaaggcatcagggaaaatgtcaaactcagggtccaagaggttgatggcactccaagagaaatatggactggttgagagggcagaaaccaggctctcaatcactcctgtgagggtagcgcagagccttcccacttggacatgtgcagcagcagcagccttaaaggagtatctcccagtggggccagcagtcatgaacctgaaggttgagaattatccccctgagatgatgtgcatggcctttggatccctgattccaactgcgggggtatctgaagccacaaccaagaccctgatggaggcctactctctgtggcaagatgccttcaccaagactatcaatgtgaagatgcgtggagccagcaagacagaagtttacaactccttcagggaccctctccatgctgctgtgaactctgtcttctttcccaatgatgttcgggtgaagtggctgaaggccaagggaatccttggcccagatggggttcccagcagagctgctgaggttgctgctgccgcttacagaaacctgtaa

SEQ ID NO: 3241 - RNA, 738 nt, synthetic construct
  misc_feature 1..738: note = derived and/or modified CDS sequence (wt) from SFTSV(ZJZHSH-HYC/China/05/2012)__KR017809.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgataatcaagaagctgaaggagacaggtggagatgattgggtgagagatacaaagttcatcattgtctttgccttgacccgaggcaataagatcgtcaaggcttcagggaaaatgtcaaactcagggtccaagaggctgatggcacttcaagagaaatatggactggttgagaaggcagaaaccaggctctcaatcacccctgtgagggtagcacagagccttcccacttggacatgtgctgcagcagcagccttaaaggagtatctcccagtgggcccagctgtcatgaacctgaaggtcgagaattaccccccagagatgatgtgcatggcctttgggtccctgattccaactgtaggggtatcagaggccacaacgaagaccctgatggaggcctactctctgtggcaagatgccttcaccaagactatcaatgtgaagatgcgtggagccagcaagacagaggtttacaactccttcagggatcctctccatgcagctgtgaactctgtcttctttcccaatgatgttcgggtgaagtggctgaaggccaaggggatccttggcccagatggggtccccagcagagctgctgaggttgctgctgctgcttacagaaacctgtaa

SEQ ID NO: 3242 - RNA, 738 nt, synthetic construct
  misc_feature 1..738: note = derived and/or modified CDS sequence (wt) from SFTSV(SPL003A)__AB817996.1__N
  source 1..738: mol_type = other RNA
atgtcagagtggtccaggattgcagtggagtttggtgagcagcagctcaatttgactgagcttgaggattttgcgagagagctggcctatgaaggcctcgatcctgcattgatcatcaagaagctgaaggagacaggtggagatgattgggtgagagacacaaagttcatcattgtctttgccctgactcgaggtaacaagatcgtcaaggcatcagggaaaatgtcaaactctgggtctaagaggttgatggcactccaagagaaatatgggctggttgagagggcagaaaccaggctctcaatcactcctgtgagggttgcacagagccttcccacttggacatgtgctgcagcagcagccctaaaggagtatctcccagtggggccagctgtcatgaacctgaaggtcgaaaattatccccctgagatgatgtgcatggcctttgggtccctgattccaactgcaggggtatctgaagccacaacgaagaccctgatggaggcctactccctgtggcaagatgccttcaccaagactatcaatgtaaagatgcgcggagccagcaagacagaggtttacaactctttcagggatcctctccatgctgctgtgaactctgtcttctttcccaatgatgtccgggtgaagtggctgaaggccaagggaatccttggcccagatggggcccccagcagagctgctgaggttgctgctgctgcttacagaaacctgtaa

SEQ ID NO: 3243 - RNA, 738 nt, synthetic construct
  misc_feature 1..738: note = derived and/or modified CDS sequence (wt) from SFTSV(SPL077A)__AB985536.1__N
  source 1..738: mol_type = other RNA
atgtcagagtggcccaggattgcagtggagtttggtgagcaacagctcaatttgactgagcttgaggattttgcgagagagctggcctatgaaggccttgatcctgctttgatcatcaagaagctgaaggagacaggcggagatgattgggtgagggacacaaagttcatcattgtctttgccctgactcgaggcaacaagatcgtcaaggcatcggggaaaatgtcaaactctgggtctaagaggttgatggcactccaagagaaatatgggctggttgagagggcagaaaccaggctctcaatcactcctgtgagggttgcacagagccttcccacttggacatgtgctgcagcagcagccctaaaggagtatctcccagtagggccagctgtcatgaacctgaaggttgagaattatccccctgagatgatgtgcatggcctttgggtccctgattccaactgcaggagtatctgaagccacaacgaagaccctgatggaggcctactctctgtggcaagatgccttcaccaagactatcaatgtgaagatgcgcggagctagcaagacagaggtttacaactctttcagggatcctctccatgctgctgtgaactctgtcttctttcccaatgatgttcgggtgaagtggctgaaggccaagggaatccttggcccagatggggtccccagcagagctgctgaggttgctgccgctgcttacagaaacctgtaa

SEQ ID NO: 3244 - RNA, 738 nt, synthetic construct
  misc_feature 1..738: note = derived and/or modified CDS sequence (wt) from SFTSV(SPL106A)__AB985548.1__N
  source 1..738: mol_type = other RNA
atgtcagactggtccaggattgcagtggagtttggtgagcaacagctcaatttgactgagcttgaggattttgcgagagagctggcctatgaaggccttgatcctgctttgatcatcaagaagctgaaggagacaggcggagatgattgggtgagggacacaaagttcatcattgtctttgccctgactcgaggcaacaagatcgtcaaggcatcggggaaaatgtcaaactctgggtctaagaggttgatggcactccaagagaaatatgggctggttgagagggcagaaaccaggctctcaatcactcctgtgagggttgcacagagccttcccacttggacatgtgctgcagcagcagccctaaaggagtatctcccagtggggccagctgtcatgaacctgaaggttgagaattatccccctgagatgatgtgcatggcctttgggtccctgattccaactgcaggagtatctgaagccacaacgaagaccctgatggaggcctactctctgtggcaagatgccttcaccaagactatcaatgtgaagatgcgcggagctagcaagacagaggtttacaactctttcagggatcctctccatgctgctgtgaactctgtcttctttcccaatgatgttcgggtgaagtggctgaaggccaagggaatccttggcccagatggggtccccagcagagctgctgaggttgctgccgctgcttacagaaacctgtaa

SEQ ID NO: 3245 - RNA, 738 nt, synthetic construct
  misc_feature 1..738: note = derived and/or modified CDS sequence (wt) from SFTSV(SPL114A)__AB985552.1__N
  source 1..738: mol_type = other RNA
atgtcagagtggtccaggattgcagtggagtttggtgagcagcagctcaatttgactgagcttgaagattttgcgagagagctggcctatgaaggccttgatcctgcattgatcatcaagaagctgaaggagacaggtggagatgattgggtgagggacacaaagtttatcattgtctttgccctgactcgaggcaacaagatcgtcaaggcaccagggaaaatgtcaaactctgggtctaagaggttgatggcactccaagagaaatatgggctggttgagagggcagaaaccaggctctcaatcactcctgtgagggttgcacagagccttcccacttggacatgtgctgcagcagcagccctaaaggagtatctcccagtggggccagctgtcatgaacctgaaggtcgaaaattatccccctgagatgatgtgcatggcctttgggtccctgattccaactgcaggggtatctgaagccacaacgaagaccctgatggaggcctactctctgtggcaagatgccttcaccaagactatcaatgtgaagatgcgcggagctagcaagacagaggtttacaactctttcagggatcctctccatgctgctgtgaactctgtcttctttcccaatgatgtccgggtgaagtggctgaaggccaagggaatccttggcccagatggggtccccagtagagctgctgaggttgctgccgctgcttacagaaacctgtaa

SEQ ID NO: 3246 - RNA, 738 nt, synthetic construct
  misc_feature 1..738: note = derived and/or modified CDS sequence (wt) from SFTSV(SPL125A)__AB985557.1__N
  source 1..738: mol_type = other RNA
atgtcagagtggtccggagttgcagtggagtttggtgagcagcagctcaatttgactgagcttgaagattttgcgagagagctggcctatgaaggccttgatcctgcattgatcatcaagaagctgaaggagacaggtggagatgattgggtgagggacacaaagttcatcattgtctttgccctgactcgaggcaacaagatcgtcaaggcatcagggaaaatgtcaaactctgggtctaagaggttgatggcactccaagagaaatatgggctggttgagagggcagaaaccaggctctcaatcactcctgtgagggttgcacagagccttcccacttggacatgtgctgcagcagcagccctaaaggagtatctcccagtggggccagctgtcatgaacctgaaggtcgaaaattatccccctgagatgatgtgcatggcctttgggtccctgattccaactgcaggggtatctgaagccacaacgaagaccctgatggaggcctactctctgtggcaagatgccttcaccaagactatcaatgtgaagatgcgcggagctagcaagacagaggtttacaactctttcagggatcctctccatgctgctgtgaactctgtcttctttcccaatgatgtccgggtgaagtggctgaaggccaagggaatccttggcccagatggggtccccagtagagctgctgaggttgctgccgctgcttacagaaacctgtaa

SEQ ID NO: 3247 - RNA, 738 nt, synthetic construct
  misc_feature 1..738: note = derived and/or modified CDS sequence (wt) from SFTSV(SPL160A)__AB985571.1__N
  source 1..738: mol_type = other RNA
atgtcagagtggtccaggattgcagtggagtttggtgagcaacagctcaatttgactgagcttgaggattttgcgagagagctggcctatgaaggccttgatcctgctttgatcatcacgaagctgaaggagacaggcggagatgattgggtgagggacacaaagttcatcattgtctttgccctgactcgaggcaacaagatcgtcaaggcatcggggaaaatgtcaaactctgggtctaagaggttgatggcactccaagagaaatatgggctggttgagagggcagaaaccaggctctcaatcactcctgtgagggttgcacagagccttcccacttggacatgtgctgcagcagcagccctaaaggagtatctcccagtagggccagctgtcatgaacctgaaggttgagaattatccccctgagatgatgtgcatggcctttgggtccctgattccaactgcaggagtatctgaagccacaacgaagaccctgatggaggcctactctctgtggcaagatgccttcaccaagactatcaatgtgaagatgcgcggagctagcaagacagaggtttacaactctttcagggatcctctccatgctgctgtgaactctgtcttctttcccaatgatgttcgggtgaagtggctgaaggccaagggaatccttggcccagatggggtccccagcagagctgctgaggttgctgccgctgcttacagaaacctgtaa

SEQ ID NO: 3248 - RNA, 738 nt, synthetic construct
  misc_feature 1..738: note = derived and/or modified CDS sequence (wt) from SFTSV(SPL163A)__AB985573.1__N
  source 1..738: mol_type = other RNA
atgtcagagtggtccaggattgcagtggagtttggtgagcagcagctcaatttgactgagcttgaagattttgcgagagagctggcctatgaaggcctcgatcctgcattgatcatcaagaagctgaaggagacaggtggcgatgattgggtgagagacacaaagttcatcattgtctttcccctgactcgaggtaacaagatcgtcaaggcatcagggaaaatgtcaaactctgggtctaagaggttgatggcactccaagagaaatatgggctggttgagagggcagaaaccaggctctcaatcactcctgtgagggttgcacagagccttcccacttggacatgtgctgcagcagcagccctaaaggagtatctcccagtggggccagctgtcatgaacctgaaggtcgaaaattatccccctgagatgatgtgcatggcctttgggtccctgatcccaactgcaggggtatctgaagccacaacgaagaccctgatggaggcctactccctgtggcaagatgccttcaccaagactatcaatgtaaagatgcgcggagccagcaagacagaggtttacaactctttcagggatcctctccatgctgctgtgaactctgtcttctttcccaatgatgtccgggtgaagtggctgaaggccaagggaatccttggcccagatggggtccccagcagagctgctgaggttgctgccgctgcttacagaaacctgtaa

SEQ ID NO: 3249 - RNA, 738 nt, synthetic construct
  misc_feature 1..738: note = derived and/or modified CDS sequence (wt) from SFTSV/FTLSV(2011YPQ12)__KF711915.1__N
  source 1..738: mol_type = other RNA
atgtcaaagtggtccagaattgcagtggagtttggtgagcagcagctcaatttgactgagcttgaggatttcgcgagagagctagcctatgaaggccttgatcctgctctgatcatcaagaagctgaaggagacaggtggagatgactgggtgaaggatactaagttcatcattgtctttgccctgactcgaggcaataagatcgtcaaggcatcagggaagatgtcaaactcagggtctaagaggttgatggcactccaggagaaatatgggctggttgagagggcaaagaccaggctctcaatcaccccagtaagggtagcgcaaagcctccccacttggacatgtgctgcagcagcagccttaaaggagtatctccctgtggggccagccgtcatgaacctgaaggtcgagaattatccccctgagatgatgtgcatggccttcgggtccctgattccaactgcaggagtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgttttcttccccaatgatgttcgggtgaagtggctgaaggccaagggaatccttggcccagatggggtccccagcaaagctgctgaggttgctgctgctgcttacaggaacctgtaa

SEQ ID NO: 3250 - RNA, 738 nt, synthetic construct
  misc_feature 1..738: note = derived and/or modified CDS sequence (wt) from SFTSV/FTLSV(2011YXX9)__KF711898.1__N
  source 1..738: mol_type = other RNA
atgtcagagtggtccagaattgcagtggagtttggtgagcagcagctcaatttgactgagctagaggatttcgcgagagagctagcctatgaaggccttgatcctgctctgatcatcaagaagctgaaggagacaggtggagatgattgggtgaaggatacaaagttcatcattgtctttgccctgactcgaggcaataagatcgtcaaggcatcagggaagatgtcaaactcagggtctaagaggttgatggcactccaggagaaatatggactggttgagagggcagagaccaggctctcaatcactccagtaagggtagcgcagagccttcccacttggacatgtgctgcagcagcagccttaaaggagtatctcccagtagggccagccgtcatgaacctgaaggtcgagaattatccccctgagatgatgtgcatggcctttgggtccctgattccaactgcgggggtatctgaagccacaaccaagaccctggtggaggcttactctttatggcaagatgccttcaccaagactatcaatgtgaagatgcgcggagccagcaagacagaagtttacaactccttcagggaccctcttcatgctgctgtgaactctgttttcttccccaatgatgttcgggtgaagtggctgaaggccaaggggatccttggcccagatggggtccccagcagagctgctgaggttgctgctgctgcttacaggaacctgtaa

SEQ ID NO: 3251 - RNA, 738 nt, synthetic construct
  misc_feature 1..738: note = derived and/or modified CDS sequence (wt) from SFTSV/FTLSV(YPQ2)__KF356519.1__N
  source 1..738: mol_type = other RNA
atgtcagagtggtccagaattgcagtggagtttggtgagcagcagctcaatttgactgagcttgaggatttcgcgagagagctagcctatgaaggccttgatcctgctttgatcatcaagaagctgaaggagacaggtggagatgactgggtgaaggatactaagttcatcattgtctttgccctgactcgaggcaataagatcgtcaaggcatcagggaagatgtcaaactcagggtctaagaggttgatggcactccaggagaaatatgggctggttgagagggcagagaccaggctctcaatcaccccagtaagggtagcgcagagcctccccacttggacatgtgctgcagcagcagccttaaaggagtatctccctgtggggccagccgtcatgaacctgaaggtcgagaattatccccctgagatgatgtgcatggccttcgggtccctgattccaactgcaggggtatctgaagccacgaccaagaccctgatggaggcttactctttatggcaagatgccttcaccaagaccatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccaaatggggtccccagcagagctgctgaggttgctgctgctgcttacaggaacctgtaa

SEQ ID NO: 3252 - RNA, 738 nt, synthetic construct
  misc_feature 1..738: note = derived and/or modified CDS sequence (wt) from SFTSV/Guertu virus(DXM)__KT328591.1__N
  source 1..738: mol_type = other RNA
atgtcggagtggtctaagattgctgtggagtttggtgagcaacagctcaatgtcatcgagcttgaggagtttgcaagagagcttgcttatgagggattagatcctgccctcataatcaagaaacttaaagaggtgggaggtgatgattggatgagagatacaaaattcataattgtatttgccctcactcgaggaaacaaaattctgaaagcagctgggaagatgtccaactctggatccaagaggatcatggccctgcaggagaagtatgggctggtggagcgggcagaaaccagactctccataactccagtcagggtggctcagagtctcccaacttggacttgctctgcagcagcagctcttcaggagtatttacctgtggggccagctgttatgagcctcaaggtgtctaatttcccaccagaaatgatgtgcatggcctttgggtcattgatccctgccaccggtgtgccggagtcaacaaccaagatattgatggaagcatattccctatggcaagatgctttcacgaaaaccatcaatgttaagatgaggggagcaagcaaggccgaggtctacaattcattcagagaccccctccatgctgctgtcaactctgtcttcttccctaatgatgttaggctgagatggctcaagtccaaggggatcctgggacctgatggcttacccagcaaggctgtggagacagctgctgctgcttacaggaacctgtaa

SEQ ID NO: 3253 - RNA, 738 nt, synthetic construct
  misc_feature 1..738: note = derived and/or modified CDS sequence (wt) from SFTSV/Huaiyangshan virus(2010-FQM)__HQ419240.1__N
  source 1..738: mol_type = other RNA
atgtcagagtggtccaggattgcagtgaagtttggtgagcagcagctcaatttgactgagcttgaggatttcgcgagagagctggcctatgaaggccttgatcctgctttgatcatcaagaagctgaaggagacaggtggagatgattgggtgaaggatacgaagttcatcattgtctttgccctgactcgaggcaataagatcgtcaaggcatcagggaaaatgtctaactcagggtctaagaggttgatggcgctccaagagaagtatggactggttgagagggcagaaaccaggctctcaatcactcctgtgagggtagcgcagagtcttcccacctggacatgtgcagcagcagcagccttaaaggagtatctcccagtggggccagccgtcatgaacctgaaggttgagaattatccccctgagatgatgtgcatggcctttggatccctaattccaactgcgggggtatctgaagccacaaccaagacccttatggaggcttactctctgtggcaagatgccttcaccaagactatcaatgtgaagatgcgtggagccagcaagacagaagtttataactccttcagggaccctctccatgctgctgtgaactctgtcttccttcccaatgatgttcgggtgaagtggctgaaggccaagggaatccttggcccagatggggttcccagcagagctgctgaggttgctgctgctgcttacagaaacctgtaa

SEQ ID NO: 3254 - RNA, 738 nt, synthetic construct
  misc_feature 1..738: note = derived and/or modified CDS sequence (wt) from SFTSV/Huaiyangshan virus(2010-ZGQ)__HQ419241.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgatcatcaagaagctgaaggagacaggtggagatgattgggtgaaggatacgaagttcatcattgtctttgccctgactcgaggcaataagatcgtcaaggcatcagggaaaatgtctaactcagggtctaagaggttgatgtcactccaagagaagtatggactggttgagagggcagaaaccaggctctcaatcactcctgtgagggtagcgcagagtcttcccacctggacatgtgcagcagcagcagccttaaaggagtatctcccagtggggccagccgtcatgaacctgaaggttgagaattatccccctgagatgatgtgcatggcctttggatccctaattccaactgcgggggtatctgaagccacaaccaggacccttatggaggcttactctctgtggcaagatgccttcaccaagactatcaatgtgaagatgcgtggagccagcaagacagaagtttataactccttcagggaccctctccatgctgctgtgaactctgtcttctttcccaatgatgttcgggtgaagtggctgaaggccaagggaatccttggcccagatggggttcccagcagagctgctgaggttgctgctgctgcttacagaaacctgtaa

SEQ ID NO: 3255 - RNA, 738 nt, synthetic construct
  misc_feature 1..738: note = derived and/or modified CDS sequence (wt) from SFTSV/Huaiyangshan virus(S-HGX)__HQ171192.1__N
  source 1..738: mol_type = other RNA
atgtcagagtggtccaggattgcagtggagtttggtgagcagcagctcaatttgactgagcttgaggatttcgcgagagagctagcctatgaaggccttgatcctgctttgatcatcaagaagctgaaggagacaggtggagatgactgggtgaaggataccaagttcatcattgtctttgccctgactcgaggcaataagatcgtcaaggcatcagggaagatgtcaaactcagggtcaaagaggttgatggcactccaggagaaatatgggctggttgagagggcagagaccaggctctcaatcacccctgtaagggtagcgcagagcctccccacttggacatgtactgcagcagcagccttaaaggagtatctcccagtggggccagccgtcatgaacctgaaggttgagaattatccccctgagatgatgtgcatggccttcgagtccctgattccaactgcaggggtatctgaagccacgaccaagaccctgatggaggcttactctttatggcaagatgccttcaccaagactatcaatgtggagatgcgcggagccagcaagacagaagtttacaactccttcagggatcctctccatgctgctgtgaactctgtcttcttccccaacgatgttcgggtgaagtggctgaaggccaagggaatccttggcccagatggggtccccagcagagctgctgaggttgctgctgctgcttacaggaacctgtaa

SEQ ID NO: 3256 - RNA, 738 nt, synthetic construct
  misc_feature 1..738: note = derived and/or modified CDS sequence (wt) from SFTSV/Huaiyangshan virus(S-HZM)__HQ171193.1__N
  source 1..738: mol_type = other RNA
atgtcagagtggtccaggattgcagtggagtttggtgagcagcagctcaatttgactgagcttgaggattttgcgagagagctggcctacgaaggccttgaccctgctttgatcatcaagaagctgaaggagacgggtggagatgactgggtgaaggacaccgagttcatcattgtctttgccctgactcgaggcaataagatcgtcaaggcatcagggaagatgtcaaactcagggtctaagaggttgatggcgctccaggagaaatatggactggttgagagggcagagaccaggctctcaatcacccctgtaagggtggcgcagagcctccccacttggacatgtgctgcagcagcagctttaaaggagtatctcccagtggggccagccgtcatgaacctgaaggtcgagaattatccccctgagatgatgtgcatggccttcgggtccctgattccaactacaggggtatctgaagccacgaccaagaccctgatggaggcttactctttgtggcaagatgccttcaccaagactatcaatgtgaagatgcgcggagccagcaagacagaagtttacaactccttcagggatcctctccatgctgctgtgaactctgtcttcttccccaatgatctccgggtgaagtggctgaaggccaagggaatccttggcccagatggggtccccagcagagctgctgaggttgctgctgctgcttacaggaacctgtaa

SEQ ID NO: 3257 - RNA, 738 nt, synthetic construct
  misc_feature 1..738: note = derived and/or modified CDS sequence (wt) from SFTSV/Huaiyangshan virus(S-WJ)__HQ171191.1__N
  source 1..738: mol_type = other RNA
atgtcagagtggtccaggattgcagtggagtttggtgagcagcagctcaatttgactgagcttgaggatttcgcgagagagctagcctatgaaggccttggtcctgctttgatcatcaagaagctgaaggagacaggtggagatgactgggtgaaggatactaagttcatcattgtctttgccctgactcgaggcaataagatcgttaaggcatcagggaagatgtcaaactcagggtcaaagaggttgatggcactccaggagaaatatgggctggttgagagggcagagaccaggctctcaatcacccctgtaagggtagcgcagagcctccccacttggacatgtgctgcagcagcagccttaaaggagtatctcccagtggggccagccgtcatgaacctgaaggttgagaattatccccctgagatgatgtgcatggccttcgggtccctgattccaactgcaggggtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggttgctgctgctgcttacaggaacctgtaa

SEQ ID NO: 3258 - RNA, 738 nt, synthetic construct
  misc_feature 1..738: note = derived and/or modified CDS sequence (wt) from SFTSV/Phlebovirus(JS2010-019)__JQ317180.1__N
  source 1..738: mol_type = other RNA
atgtcagagtggtccaggattgcagtggagtttggtgagcagcagctcaatttgactgagcttgaggatttcgcgagagagctagcctatgaaggccttgatcctgctttgatcatcaagaagctgaaggagacaggtggagatgactgggtgaaggatactaagttcatcattgtctttgccctgactcgaggcaataagatcgtcaaggcatcagggaagatgtcaaactcagggtcaaagaggttgatggcactccaggagaaatatgggctggttgagagggcagagaccaggctctcaatcacccctgtaagggtagcgcagagcctccccacttggacatgtgctgcagcagcagccttaaaggagtatctcccagtggggccagccgtcatgaacctgaaggtcgagaattatccccctgagatgatgtgcatggccttcgggtccctgattccaactgcaggggtatctgaagccacgaccaagaccctgatggaggcttactctttatggcaagatgccttcaccaagactatcaatgtgaagatgcgcggagccagcaagacagaagtttacaactccttcagggatcctctccatgctgctgtgaactctgtcttcttccccaatgatgttcgggtgaagtggctgaaggccaagggaatccttggcccagatggggtccccagcagagctgctgaggctgctgctgctgcttacaggaacctgtaa

SEQ ID NO: 3259 - RNA, 738 nt, synthetic construct
  misc_feature 1..738: note = derived and/or modified CDS sequence (wt) from SFTSV/Phlebovirus(SD24/China/2010 strain SD24)__HM802205.1__N
  source 1..738: mol_type = other RNA
atgtcggagtggtccaggattgcagtggagtttggtgagcagcagctcaatttgactgagcttgaggacttcgcgagagagctggcctatgaaggccttgaccctgctttgatcatcaagaagctgaaggagacaggtggagatgattgggtgaaggatacaaagttcatcattgtctttgccctgactcgaggcaataagatcgtcaaggcatcagggaaaatgtcaaactcagggtccaagaggttgatggcactccaagagaaatatggactggttgagagggcagagaccaggctctcaatcactccagtgagggttgcgcagagccttcccacttggacatgtgctgctgcagcagctctaaaggagtatctcccagtagggccagccgtcatgaacctgaaggttgagaattatccccctgagatgatgtgcatggcctttggatccctgattccaactgcgggggtaactgaagccacaaccaagaccctgatggaggcctactctctgtggcaagatgccttcaccaagactatcaatgtgaagatgcgcggagccagcaagacagaagtttacaactccttcagggaccctcttcatgctgctgtgaactctgtcttctttcccaatgatgttcgggtaaagtggctgaaggccaaggggatccttggcccagatggggtccccagcagagctgctgaggttgctgctgctgcttacagaaacctgtaa

SEQ ID NO: 3260 - RNA, 738 nt, synthetic construct
  misc_feature 1..738: note = derived and/or modified CDS sequence (wt) from SFTSV/Phlebovirus(ZJ1/China/2011)__HE663216.1__N
  source 1..738: mol_type = other RNA
atgtcagagtggtccaggattgcagtggagtttggtgagcagcagctcaatttgactgagcttgaggatttcgcgagagagctggcctatgaaggccttgatcctgctttgataatcaagaagctgaaggagacaggtggagatgattgggtgagagatacaaagttcatcattgtctttgccttgacccgaggcaataagatcgtcaaggcttcagggaaaatgtcaaactcagggtccaagaggctgatggcacttcaagagaaatatggactggttgagaaggcagaaaccaggctctcaatcacccctgtgagggtagcacagagccttcctacttggacatgtgctgcagcagcagccttaaaggagtatctcccagtgggcccagctgtcatgaacctgaaggtcgagaattaccccccagagatgatgtgcatggcctttgggtccctgattccaactgcaggggtatcagaggccacaacgaaggccctgatggaggcctactctctgtggcaagatgccttcaccaagactatcaatgtgaagatgcgtggagccagcaagacagaggtttacagctccttcagggatcctctccatgcagctgtgaactctgtcttctttcccaatgatgttcgggtgaagtggctgaaggccaaggggatccttggcccagatggggtccccagcagagctgctgaggttgctgctgctgcttacaggaacctgtaa

SEQ ID NO: 3261 - RNA, 3417 nt, synthetic construct
  misc_feature 1..3417: note = derived and/or modified CDS sequence (wt) from ANDV(Chile-9717869)__AF291703.2__GP
  source 1..3417: mol_type = other RNA
atggaagggtggtatctggttgttcttggagtctgctatacgctgacactggcaatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaattctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaattcacaaagtcacttaagaatagtgggacctatcacagcaaaagtgccatcaactagttccacagataccctaaaggggacagcctttgcaggcgtcccaatgtatagctctttatctacactagtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagcttgaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaa

SEQ ID NO: 3262 - RNA, 3417 nt, synthetic construct
  misc_feature 1..3417: note = derived and/or modified CDS sequence (wt) from ANDV(AH-1)__AF324901.2__GP
  source 1..3417: mol_type = other RNA
atggaagggtggtatctggttgctcttggagtctgctatacgctgacactggcaatgcctaaaaccatttatgagcttaaaatggaatgcccgcatactgtgggtctcggtcaaggttacattattggctcaacagaattgggtttgatctcaattgaggctgcatctgatataaagcttgagagctcttgtaattttgatcttcatacaacatctatggcccagaagagtttcacccaagttgaatggagaaagaaaagtgacacaactgataccacaaatgctgcatctaccacctttgaagcacaaaccaaaactgttaaccttagagggacctgtatattggcacctgaactttatgatacattaaagaaagtaaaaaagacagttctgtgctatgatctcacatgcaatcaaacacattgtcagccaactgtatatctgattgcacctgtactgacatgcatgtcaattagaagttgtatggctagtgtgtttacaagtaggattcaggtgatctatgaaaagacgcattgtgtaacaggtcagctgattgagggtcagtgcttcaacccagcacacacattgacattatctcaacctgctcacacttatgatactgtcaccctgcctatctcttgtttttttacaccaaagaagtcggagcagctaaaagttataaaaacatttgaagggattctgacaaagacagggtgcacggagaatgcattgcaaggttattatgtgtgttttttagggagtcattcagaacctttaatcgttccaagtctggaggacatacgatctgctgaagttgtcagtaggatgcttgtacaccctataggagaggaccatgatgctatacaaaattcacagagttacttgagaatagtgggacctatcacagcaaaagtgccatcaactagttccacagataccctaaaggggatagcctttgcgggcgtcccaatgtatagctccttctctacactagtcaggaatgcggacccagaatttgtgttttctccaggtataatacctgaatctaatcacagtgtatgtgataagaagacagtacctatcacatggacaggctacctaccaatatcaggggagatggaaaaagtgactggatgtacagttttctgtacactggcaggacctggtgctagctgtgaggcctactctgagaatggtatctttaacatcagttccccgacatgccttgtcaacaaagtccaaagatttagaggatctgaacagaagataaattttatctgtcagcgggtagatcaggatgtcgttgtatactgtaatgggcagaagaaagtcatattaaccaagactttggttattgggcagtgtatttatacattcacaagcctattttcattgatgcctgatgtagcccattcactcgctgtagaattatgtgtcccaggattacatgggtgggccactgttatgcttctatcaacattctgcttcgggtgggtcttgattcctgcagtaacgttaataatattaaaatgtctaagggttctgacattttcttgttcccattacactaatgagtcaaaatttaaattcatcctggaaaaagttaaagtcgaataccagaagactatgggatcaatggtgtgtgatgtatgtcatcacgagtgtgaaacagcaaaggaacttgaatcacatagacaaagttgcattaatggacaatgcccttattgcatgacaataactgaggcaactgaaagtgccttgcaagcccattattccatttgtaaattgacaggaagatttcaagaggcattaaaaaagtcacttaagaagccagaggtaaaaaaaggttgttacagaacacttggggtatttcgatacaaaagtagatgttatgtgggtttggtatggtgcctattgttgacatgtgaaattgttatttgggctgcaagtgcagagactccactaatggagtcaggttggtcagatacagctcatggtgttggcgagattccaatgaagacagacttagagctagacttttcactgccctcttcatcctcttatagttacaggagaaagctcacaaatccagctaataaggaagagtctattcccttccatttccagatggaaaaacaagtgattcatgctgagatccagcccttaggtcattggatggatgcaacatttaatattaagactgcatttcattgttatggtgcatgtcagaagtactcttatccatggcaaacatctaagtgcttctttgaaaaagactaccagtatgaaacaggctggggctgtaatcctggtgactgcccaggggttgggactgggtgcactgcttgtggtgtttatcttgataaactaaaatctgtgggaaaggcctataagataatttctttaaaatacaccaggaaggtttgcattcagttaggaacagaacaaacatgcaagcatattgatgcaaatgattgtttagtaacaccatctgtgaaggtttgcatagtgggcacagtttctaaactccaaccatctgatactcttttgttcttaggtccattagaacaaggaggaatcatccttaaacaatggtgcacaacatcatgtgcatttggggaccccggtgatatcatgtctactcctagtggtatgaggtgtccagaacacactggatcattcaggaaaatttgtggttttgccactacaccagtttgtgaatatcaagggaatactgtttctggatacaaaagaatgatggcaacaaaagattcatttcaatcatttaacttaacagaacctcacatcacaacaaataagcttgaatggattgacccagatgggaatacaagagaccatgtaaaccttgtcttaaatagagatgtttcatttcaggatttaagtgataacccctgtaaagtggacttacacacacaggcaatagaaggggcatggggttctggtgtagggtttacacttacatgtactgtcggattaacagagtgccctagttttatgacatcaattaaggcatgtgatcttgctatgtgttatggatcaacagtagcaaaccttgccaggggctctaatacagtaaaagtagttggtaagggaggtcattcagggtcttcatttaaatgctgtcatgatacagattgctcttctgagggtctacttgcatcagccccacatcttgagagagtgacaggcttcaatcaaatcgattcagataaggtttatgatgatggtgcaccaccttgcacattcaaatgctggttcaccaagtcaggtgagtggctccttgggatcttaaacgggaattggattgttgttgtagtgcttgttgtgatactcattctctctatcataatgttcagtgttctgtgccccaggagaggacacaagaaaactgtctaa

SEQ ID NO: 3263 - RNA, 3417 nt, synthetic construct
  misc_feature 1..3417: note = derived and/or modified CDS sequence (wt) from ANDV(CHI-7913)__AY228238.1__GP
  source 1..3417: mol_type = other RNA
atggaagggtggtatctggttgctcttggaatctgctatacgctgacactggcaatgcctaaaaccacttatgagcttaaaatggaatgcccgcatactgtgggtctcggtcaaggttacattattggctcaacagaattgggtttgatctcaattgaggctgcatctgatataaagcttgagagctcttgtaattttgatcttcatacaacatctatggcccagaagagtttcacccaagttgaatggagaaagaaaagtgacacaactgataccacaaatgctgcatccaccacctttgaagcacagaccaaaactgttaaccttagagggacctgtatattggcacctgaactttatgatacattaaagaaagtaaagaagacagtcctgtgctatgatcttacatgcaatcagacacattgtcagccaactgtctatctgattgcacctgtactgacctgcatgtcaattagaagttgtatggctagagtgtttacaagtaggattcaggtgatctatgaaaagacacattgtgtaacaggtcagctgattgagggtcaatgtttcaacccagcacacacactgacattatctcaacctgctcacacttatgatactgtcaccctgcctatctcttgtttttttacaccaaaggagtcggagcagctaaaagttataaaaacatttgaagggattctgacaaagacagggtgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaattcacaaagtcacttgagaatagtgggacctatcacagcaaaagtgccatcaactagttccacagataccctgaaggggacagcctttgcaggcgtcccaatgtacagctccttatctacactagtcaaaaatgcagacccagaatttgtgttttccccaggtataatacctgaatctaatcacagtgtatgtgataagaagacagtacctatcacatggacaggctacctaccaatatcaggggagatggaaaaagtaactggatgtacagttttctgtacactggcgggacctggtgctagctgtgaggcctattctgaaaatggtatctttaacattagttccccaacatgtcttgtcaacaaagtccaaagatttagaggatccgaacagaagataaattttatctgtcagcgggtagatcaggatgtcgtcgtatactgtaatggacagaagaaagtcatattaaccaaaactttggttattgggcagtgtatttatacattcacaagcctattttcattgatgcctgatgtagcccactcactcgctgtagaattatgtgtcccaggattacatgggtgggccactgtcatgcttctatcaacattctgcttcggatgggtcttgattcctgcagtaacgttaataatattaaaatgtctaagggttctgacattttcttgttcccattacactaatgagtcaaaatttaaattcatcctggaaaaagttaaagtcgaataccaaaagactatgggatcaatggtgtgcgatgtatgtcatcacgagtgtgaaacagcaaaggaacttgaatcacatagacaaagttgcatcaatggacaatgcccttattgcatgacaataactgaagcaactgaaagtgccttgcaagcccattattccatttgtaaattgacaggaagatttcaggaggcattaaaaaagtcacttaagaagccagaggtaaaaaaaggttgttacagaacacttggggtatttcgatataaaagtagatgttatgtgggtttggtatggtgcctattgttgacatgtgaaattgttatttgggccgcaagtgcagagactccactaatggaatcaggttggtcagatacagctcatggtgttggcgagattccaatgaagacagacttagaactagacttttcactgccttcttcatcctcttatagttacaggagaaagctcacaaacccagctaataaggaagagtcaatttcctttcatttccagatggaaaaacaagtgattcatgctgagatccaacccttaggtcattggatggatgcaacatttaataccaagactgcatttcattgttatggtgcatgtcagaaatactcttatccatggcaaacatctaagtgcttctttgaaaaagattaccagtatgaaacaggttggggctgtaatcctggtgactgcccaggggttgggactggatgtactgcttgtggtgtttatcttgataaactaaaatctgtgggaaaagcctataagataatttctttaaaatacaccagaaaggtttgcattcagttaggaacagaacaaacatgcaagcatattgatgcaaatgattgtttagtaacaccatctgtgaaggtttgtatagtgggcacagtttctaaactccaaccatctgatactcttttgttcctaggtccgttagaacaagggggggtcatccttaaacaatggtgcacaacatcatgtgcatttggggaccctggtgatatcatgtctactcctagtggtatgaggtgtccagaacacactggatcattcaggaaaatttgtggttttgccactacaccagtttgcgaataccaaggtaataccatttctggatataaaagaatgatggcaacaaaagattcattccaatcatttaacttaacagaacctcacatcacagcaaataagcttgaatggattgacccagatgggaatacaagagaccatgtaaaccttgtcttaaatagagatgtttcatttcaggatttaagtgataacccctgtaaagtggacttacacacacaagcaatagaaggggcatggggttctggtgtagggtttacacttacatgtactgtcggattaacagagtgcccgagttttatgacatcaattaaggcatgtgatcttgctatgtgttatggatcaacagtagcaaaccttgctaggggctctaatacagtaaaagtggttggtaagggaggtcattcagggtcttcatttaaatgctgtcatgatacagattgctcctctgagggtctacttgcatcagccccacaccttgagagagtgacaggcttcaatcaaatcgattcagataaggtttatgatgatggtgcaccaccttgcacattcaaatgctggttcaccaagtcaggtgagtggctccttgggatcttaaacgggaattggattgttgttgtagtgcttgttgtgatactcattctctctatcataatgttcagtgttctgtgccccaggagaggacacaagaaaactgtctag

SEQ ID NO: 3264 - RNA, 3417 nt, synthetic construct
  misc_feature 1..3417: note = derived and/or modified CDS sequence (wt) from Hu39694(Hu39694)__AF028023.1__GP
  source 1..3417: mol_type = other RNA
atggaagggtggtatttgattgtcttgggagtctgctctacattgacactggcaatgcctagaaccatctatgaactcaggatggaatgcccgcatactgtgggcttgggtcaaggttatattatagggtcaactgagctcgggctgattccgattgagactgtatcggatttgaagctagaaagctcatgtaattttgacctccatacaacctcaatgactcaaaaaagctatacacaagttgagtggaggaagaaaagtgatacaactgacacaacaaatgctgcatcaacaacatttgaagcacagactaagacagtaaaccttcgtgggacgtgtgtgctggcatcagaactctatgacacattgaagaaaattaaaaagacagtcctctgttatgatttaacctgtaaccaaacacattgccaaccaacagtctatctgattgcaccagtatctacatgcatgtcaataaggagctgcatggcaagtgtcttcactaataggattcaggtgatttatgagaagactcattgtgtcacagggcaactagttgagggtcaatgctttaatcctgcacatactctaactctctcacagccagcccacacctatgagatggtaacattaccagtcacctgcttttttacacctaaaaaatctgatcagttgaagctgataaagacatttgagggaataatcagtaaaacaggctgcacagagaatgcactgcaagggtattatgtttgcttccttggcagtcattcagaacctttgcatgttccgagcttagaagacatccgttcagttgaagtgttcagtagaatgattatacatccaaggggtgaagatcatgatccaattcaaaactcacagggattcttacggatagttggcccaataacagcaaaagtgccaagtaccagttctactgatacccttaaagggactgcatttgctggtgtcccaatgtacagctctttatcaacactggtgagaaccacagatccagagtatgtcttttcacccgggataataccagagtccaatcacagtacctgtgacaagaagactatccctcttacatggacaggttatcttcccattgcaggcgagatggaaaaagtcactggatgtacagtcttctgtactttggcaggccctggagcaagttgtgaggcttactctgagcatggtatctttaatattagctcacctacttgtcttgtccacaaagtacagaaattcaggggctcagagcaaaagattaatttcatttgtcagagggttgatcaagatgtagttgtttattgtaatgggcagaagaaggtaattctgacaaaggatctggtaataggccaatgcatatacactttcacaagcctgttctcattgatgcctgatgtggcccattcattagccgttgagttatgtgtgccaggtttgcatggatgggcaactgtcatgcttctatcaaccttttgttttggatggatcctaataccagcaattaccttagttgtcctaaaattcttaaagatggcaacattctcttgttcacattataccaatgagtcaaaattcaaatttatattagagaaagttaaggttgagtaccaaaagacaatgggatccatggtttgtgatatctgccaccatgagtgtgaaacagcaaaagaattagaatcccataaacaaagctgcatcaacgggcaatgcccttactgtatgaccatgacagaggcaacagaaagtgccttacaggctcattactctatttgtaaattaacaggcagattccaggaagctttaaagaaatcactgaagagaccagaagtcaaaaagggttgttatcgtacattaggggtatttaggtacaagagtagatgctatgttgggctggtgtggtgtgtgctcttaacatgtgaacttatcgtatgggctgctagtgcagagactccacttcttgagtcaggatggtcagatacagcacatggtgtaggagaggttccaatgaaaacagatttggagctggatttttcacttccatcttcatcttcttacagctacagaagaaaactgaccaatcctgcaaacaaggaggaatcaatcccttttcattttcagatggaaaagcaagtgatacatgcagaaattcaaacattggggcattggatggatgcaacattcaatattaaaactgcatttcattgttatggtgcctgccaaaagtattcttacccgtggcaaactgcaaaatgtttcttcgagaaagattatcagtatgaaactggctggggttgcaatcctggggactgtcctggatttggaacgggctgcactgcttgtggtgtgtatttagataagcttaaatctgttggaaaggcatataagatcatctctctgaaatacaccaggaaggtttgcatccaactaggtacagagcaaacatgcaaacatattgatgcaaatgactgtttagtgacaccatctgtgaaagtatgcattataggaactgtctcaaagctccagccttctgataccttgttgttcctaggccctttagaacaaggggggattctactgaagcaatggtgtactacttcatgtgcatttggggatcctggtgatataatgtcaacaactagtggaatgagatgccccgaacatactgggtccttccgaaaaatttgtgggtttgcaacaacacctgtttgtgagtaccaagggaacacaatctcaggatataaaagaatgatggccacaaaggattcattccaatctttcaatttgactgatccacatattacaacaaataaacttgaatggattgaccctgatggtaacacacgcgatcatgtaaatttagtattgaatagagatgtttcatttcaggatctaagtgataacccatgtaaggttgatctacacacacaagctatagaaggagcatggggttcaggtgttggatttacattaacttgtactgtcggattgactgagtgccctagtttcattacatcaattaaagcatgtgatatggcaatgtgttacggatcaactgtctctaatttagctaggggttccaatacagtgaaggtagtaggtaaaggtgggcattcaggtcttcattcaaggtgctgtcatgatacagactgttcatctgagggtcttgtggcatcagcaccacatttagagagagttactgggtttaaccaaattgattctgacaaggtatatgacgatggtgctcctccatgtacattcaagtgctggttcactaagtctggagagtggctcctcggaattttaaatggtaactggattgttgttgttgtgcttgtagtggttctgatcttttctataatactctttaatatcttatgcccacggagagggcacaagaagactgtttaa

SEQ ID NO: 3265 - RNA, 3417 nt, synthetic construct
  misc_feature 1..3417: note = derived and/or modified CDS sequence (wt) from LECV(Of22819)__AF028022.1__GP
  source 1..3417: mol_type = other RNA
atggaagggtggtatttgattgtcttgggagtctgctctactttgacactggcaatgccgaaaaccatttatgaactcaaaatggaatgcccgcatactgtgggactcggtcaagggataattgttggttctacagagcttgggttgataccaattgagacagcatcagacttaaagcttgaaagttcatgcaatttcgatctgcatactacatccatgacccaaaaaagttatacacaggttgagtggagaaaaaagagcgacacaactgacacaactaatgctgcagccacgacattcgaatcacaagctaaaactgtgaaccttcgtgggacttgtgttttggctgcagagctatatgacaccttaaagaaggttaaaaagacggtgttgtgctatgatcttacctgtaatcagacacattgtcagccaacagtttatttgattgcacctgtgattacatgtatgtcaataaggagctgcatggcaagtgtctttattagcaggatccagataatatatgaaaagacacactgtgtgacgggtcaattaatagagggccaatgttttaatcctgcacacactctgacacttgctcagcctgctcacacatatgagacagttacactccctgttacctgtttttttacacctaaaaagtctgatcagcttaagttgataaaaacatttgaggggataattagtaaaacaggctgtacagaaaatgcactacaaggctattatgtttgttttctcggaagtcattctgaaccccttcatgtcccaagtctaaaagacatccggtcagcagaagtcgttacccgaatgattgtccatcctagaggtgaggaccatgacccaatccaaaactcacagggttaccttcggatagtgggaccattaacagcaaaagtaccgagcaccagctctagtgatactctgcagggaacagcatttgcaggtgttccaatgtatagctctttatctactttggtgaggaatacagaccctgaatttgtattctcaccagggattataccagaatccaaccatagtgcgtgtgataagaagaccatcccactcacctggactggttacttaccgatctcaggtgaaatggagaaggtaacaggctgtacagtcttttgcacattagctggccctggggcaagttgtgaggcttactctgaaagcggtatattcaacataagttccccaacatgccttgtcaataaagttcaaaagttcagaggttcagagcagaagatcaactttatctgccaacgagttgatcaggatgtcgttgtatattgtaatggccagaagaaggtgatcttgacaaaaaccttagtaattgggcagtgcatatacacctttactagcctgttctcattgatgcctgatgttgctcattctctagcagtagagctgtgtgttccaggattgcatgggtgggcaactgtaatgcttttgtccaccttttgctttgggtggatcctgataccagcaatcacattggtggttttgaaggttctaaaagtagcaacattctcatgctcacattatactaatgagtctaaatttaaattcatactggaaaaagtcaaggttgagtatcaaaaaacaatgggctcaatggtctgtgacatatgccaccatgagtgtgagacagccaaagaattggaatctcataagcaaagttgcataaatggtcaatgtccatattgtatgactatgactgaggcaacagaaagtgcgctacaagctcattttgctatttgtaagcttacagggagattccaggaagccttaaaaaaatcattgaagaaaccagaagtcagaaagggctgttaccgtactctaggagtttttagatacaagagcaggtgctatgttggcttagtttggtgtgtgttattgacatgtgagctcattgtatgggctgctagtgcagagacccccttgctagaatcaggctggtcagatacagcacatggggttggggaggttccaatgaaaacagatttagagttagacttttccctaccatcatcatcatcttacagttataggcggaaacttaccaatcctgccaataaagaagaatcaatccccttccactttcagatggaaaagcaagtaatacatgcagaaatccaaaacttgggtcattggatggatgcaacatttaatataaaaacagcatttcactgctatggagcctgtcaaaaatattcatatccatggcagactgcaaagtgtttctttgaaaaagattatcaatatgagacaggttggggatgtaaccctggggactgccctggagtaggtacaggctgtacagcatgtggtgtttatcttgataaactaaagtctgtagggaaggcatacaaaatcatttccttaaagtatactagaaaagtgtgtattcaattgggtacagaacagacatgtaaacatattgatgcaaatgattgcctggtgaccccttctgttaaagtatgcattgtgggaacggtttctaaacttcagccttctgacactttgctgtttctcgggccgttagagcaaggtggcattattttaaaacaatggtgtactacatcttgtgcatttggggaccctggtgacatcatgtcgacaacaagtgggatgagatgccctgagcatactggatctttccggaaaatctgtggatttgctacgacacctgtatgtgagtaccaaggtaacactatatctggatacaagagaatgatggctacaaaggattcttttcaatcatttaatcttactgaccctcacataactacaaataagcttgaatggatcgatccagatggcaatacacgagatcatgtcaatcttgtattgaatagagatgtgtcatttcaagatttaagtgacaatccttgtaaggttgatttgcatacacaagctattgaaggggcttggggttctggtgttgggtttacattgacttgcactgttggtttaactgaatgcccaagctttatgacatcaattaaagcatgtgatctagcaatgtgttatggttctacagttcataacttagcaaggggttcaaacacagtcaaagtggttggtaaaggtggacattcaggttcttcctttaagtgttgccatgacactgactgctcttctgaaggccttgttgcatcagcaccacatcttgagagagtcactggttttaaccaaatcgactcggacaaggtctatgatgatggtgcccctccatgtacatttaagtgctggttcactaaatctggagagtggctcttggggattctcaacggcaattggatagttgttgttgttcttgtggtggttctgattttctctataattttatttagcatcctttgtcctcgacggggacataagaagactgtttaa

SEQ ID NO: 3266 - RNA, 3417 nt, synthetic construct
  misc_feature 1..3417: note = derived and/or modified CDS sequence (wt) from ORNV(Ol22996)__AF028024.1__GP
  source 1..3417: mol_type = other RNA
atggaagggtggtatttgattgtcttgggggtctgctctacagtcacactggcaatgcctaaaaccatttatgaactcaaaatggaatgtccacataccgttggtcttggtcaagggtatattataggctcgactgagcttaacttgatacccattggggctgcatcagacctgaagctagaaagttcatgcgattttgacttatacaccacgccaatgacccaaaaaagctatacacaggttgaatggaggaagaaaagtgaaacaactgacaccacaaatgctgctgctacgacatttgaatcacagacaaagactgtaaacctacgtgggacctgtatcctggcctcagaattgtatgataccttgaataaaatcaagaagcctgtattgtgctatgatctcaactgcaaccaaacacgctgccagccaacagtttacttgattgcccctgtgatcacatgcatgtcaataaggagttgtatggcaagtgtgtctaacagcagaatccaaataatttatgaaaagacacattgtgtcactgggcaactagttgaaggccaatgctttaatccctcacacacgctaacacttgctcagcctgctcatacctatgagacagtaactctccctgttacttgtttctttacaccaaagaagtctgaccaactcaagttagtaaaaacatttgaaggaataattaccaaaactggctgtacggaaaatgcactacagggttattatgtatgttttcttggaagtcactcagagcctctacatgtgccaagtctagaagatatccgttcagcagaggttgtcagtaggatgatagtacatcctcgaggtgaggatcatgacccaatccaaaattcacaaggccacttgcggatagtcggaccgataacagcaaaggtaccaagcactagttctagtgacaccttacaaggaacggcattttctggtgtaccaatgtacagttcattatcaacacttgtacggagtgcagacccagaatttgtgttttcaccagggatcttgcctgaatctaaccatagtgtatgtgataaaaagactctccctctcacatggacaggttatttgcctatctctggtgaaatggaaaaagtaactggatgcactgtcttttgtaccttagctggcccaggagcaagttgtgaggcctattcagagaatgggatctttaacataagttccccaacatgccttgtcaataaagtgcagaaattccggggctctgaacaaaagatcaatttcatttgccaaagaatggatcaggatgttgttgtttactgcaatggtcaaaagaaggtgatactgacaaaaacactagttattggacaatgcatttatacattcacaagcctgttttcattaatgcctgatgttgcccattctttggcagttgaattatgtgtgcctgggctgcacgggtgggccactgttatgctcctttccaccttttgttttggctggatcctaataccagcaattactctagttgtcctaaagttcttaaaaatggcaacattctcatgctcacattatacaaatgaatctaagtttaagctcatactagagaaggtgaaagtagaataccagaaaacaatgggctcaatggtctgtgacatatgccaccatgaatgtgagacagcaaaagtgttagaatcacataaacaaagctgcattaatggacagtgcccgtactgcatgactatgactgaggcaactgaaagtgctctacaagctcattattctatctgcaaattgacagggaggtttcaggaggctttaaaaaaatcattaaaaaaaccagaggtaaaaaggggttgttaccgtaccttaggtgtatttagatacaagagtagatgttatgttggattagtttggtgtgtgcttttaacatgtgagcttattgtctgggcagctagtgcggaaactccactgctggaatcaggatggtcagatacagcccatggtgttggagaaatcccgatgaagactgatttagaacttgatttttcacttccttcctcatcttcttacagctatagacgaaagctcactaaccctgcaaataaggaagaatcaatccctttccactttcaaatggaaaaacaagtgattcatgctgaaattcaaacattaggccattggatggatgccacatttaacattaagactgcatttcattgttatggggcatgccaaaaatattcatacccctggcaaactgcaaaatgcttttttgaaaaggattatcagtacgaaacaggttggggctgcaaccctggggattgtcctggggtaggtacaggttgcactgcctgtggtgtttacctggacaaactaaaatctgtagggaaggcatataaaattatctcattgaagtatactcgaaaagtttgtatccaactaggaacagagcagacttgtaagcatattgatgcaaatgactgtttagtaactccatctgtaaaagtatgtattgttgggactgtgtccaagcttcagccttcggatacgctacttttccttgggccgttagagcaaggtggaataatactaaagcaatggtggaccacatcttgcgcctttggagatccaggggatataatgtcaacaactagtggtatgagatgtccagagcatactggctcattcaggaagatctgtggatttgcaacaacacctgtatgtgagtatcaagggaataccatctcaggctataaacgaatgatggcaacaaaggattcatttcaatcatttaacctcactgacccacacatcacaacaaacaaacttgaatggattgaccctgatggcaatacaagggatcatgtaaatctcgttttaaatagagacgtctcatttcaggatttaagtgacaacccgtgtaaggttgatttacatacacaggcaatagaaggggcatggggttctggtgttggatttacacttacatgtacagttggtttgactgagtgtccaagtttcatgacctcaatcaaagcctgtgaccttgcaatgtgttacggatcaacagttactaacctggctagagggtctaatacagttaaggttgttggaaaaggtggacattcaggctcctcattcaaatgttgtcatgatactgattgttcttctgaagggcttgttgcatcggctccacaccttgagagggtcacagggttcaatcagattgactctgataaggtctatgatgatggtgctcccccttgtacattcaggtgctggttcaccaaatctggggaatggcttctaggaatcttgaatggtaactggattgttgttgtagtgctcatagtggtattgatcttttctatagtgctctttagtatcctctgcccccggagaggacacaagaaagctgtgtaa

SEQ ID NO: 3267 - RNA, 3426 nt, synthetic construct
  misc_feature 1..3426: note = derived and/or modified CDS sequence (wt) from BCCV__L39950.1__GP
  source 1..3426: mol_type = other RNA
atgggcaggttatacctgattgtgcttggggtcctgattactgctacagctggtttcccgcggagtgtgcatgaattaaaaattgaatgcccgcatactgtcgtattagggcaaggatatgtcacaggttctgttgagcttggctttattgctcttgatcaagtaacagatttaaagattgagagctcctgtagctttgatcatcatgcagcacctacaacaacacagaacttcacacagctcaaatgggcaaaaacagcaagcacaactgacaccacaaatgcagccgagactacatttgaaagcaagtccacggaagtgcacttaaaaggagtatgtacaattcccagcaatgtgctcgacggaccatctcgccctgtaacagggagaaaaacagttgtctgttatgatttagcatgcaatcaaactcattgtcagccaactgttcatttgctagcaccaatacaaacatgcatgtctgttcggagctgtatgataagcttattggcaagtaggattcaggtggtctatgagaagacatactgtgttacaggacaacttatagaaggcttgtgttttaaccctgtccctaaccttgcactgacacaacctgggcacacatatgacacatttacattgccaattacatgctttctggtggccaaaaagggtgcaaacctgaaaattgctgttgagctagagaaactgacaacaaagactggttgtgcagaaaatgcacttcaggcttactatatatgctttataggacagcactctgagccattaactgtcccgatgctcgaggactatagatcagctgaaattttcacaagaataatgatgaatccaaaaggtgaagatcatgatatggaacagtcttcccaaggtgctttgcgaattgttgggcctataaaaggtaaagtgccacccactgagacatcagacactgtgcaggggattgcttttgcaggtttgcctatgtatagttctttttcgagccttgtaaggaaagcagaacctgaatatctattttcacctggtatcattgcagaatctaatcatagcagctgcgataagaaaacattacccttaacatggaggggtttcttatcaatgtctggtgaaattgaaagaattactggctgtaatgtcttttgtacacttgctggcccaggtgcaagttgtgaggcttactctgaaaatggaatattcaatattagttctcccacatgcttagtcaataaagtccaaaagtttaggggctcagaacagagaatcaactttatctcccaaagaatagatcaagatgtgattgtctattgtaatggacaaaagaaggtcattctgacaaaaacactagttataggccaatgtatttatacatttacaagtatcttttcactgatccctagtgttgcacattccttggctgtcgagctctgtgtaccagggatccatggatgggctacaattgcattagtaatcacattttgctttggctggttacttattcctaccacaaccatggttgtgttgaaatgcctgaggctgctaacttactcgtgctctcactattctactgaatcaaagttcaaagtcattctagaaaaggtgaaggttgaataccagaagacaatgggttcaatggtatgtgacatttgtcatcatgaatgtgaaacagcaaaagaacttgaaagccataaaaaaagttgtgctgatgggcagtgcccatactgtatgactattaccgaggcaactgagagtgctttacaggcccattatgctgtatgtaaattaacagggcgctttcatgaggctttaaaaaaatcattaaaaaaaccagaggttcagaggggttgttatagaacacttggtgttttccgttataagagtcgttgctatgtgggcttagtatggatgtgtttgttgactcttgagttgatcgtttgggctgctagtgcagatacacccttacttgaacctggctggtcagatacagctcatggggtaggtgatattccgatgaagacagacctagagttagattttgctatcccatcatcttcatcatatagttatagaaggcgattagtaaaccctgctaattcagatgagactgttccatttcactttcagcttgaacgacaagtaatccatgcagaaatacaatcgctaggacattggatggatgccacatttaatataatttctgcatttcactgctatggtgagtgcaagaaatactcttacccttggcaaacagcaaaatgtttttttgagaaggactaccagtatgaaacaagttggagctgtaatccgccagactgtccaggggtaggtactggttgtactgcatgtggcatatatctggataaattgaagtctgttgggaaagcatataaagtaattaccttgaaatatgcaagaaaagtttgcattcaattaggtacggaacaaacatgtaagaatatcgatgttaatgactgtcttgtaacttcatcaatcaaagtttgtatgattggcacaatctcaaagtttcaaccaggagacactttactatttttgggtccacttgaagaaggtggcctagtcctcaaacaatggtgtacaacaacatgttcatttggtgatccaggtgatattatgtctacaacttcaggaatgcgttgccctgaacatacaggctcctttaggaagatctgtgggtttgcaacaacacctgtttgtgagtatcaagggaatacagtctctggttttaaaagattgatggctacaaaggactcgtttcagtcatttaatgtatctgaagtacacattacaacaaccaagctagaatggagtgatcctgatagtaacatcaaagatcatataaatttgattttaaaccgagatgtatcatttcaagacttaagtgacaatccgtgcaaagtggacctttcaacacaggcaattgatggtgcatggggctctggtgtaggttttacattgacatgtatagtgggattaacagaatgctctagtttcatgacctctattaaggtatgtgacatggctatgtgttatggagcctcagtagtaaacctagttagaggctccaatacagttaaaattgttggaaaaggtggtcattctggttcgacatttagatgctgtcatgataaggactgtacaagtaatggtctgcttgcatctgcaccacatcttgaacgggttacaggattcaatcagatagattctgacaaggtttatgatgatggagctccaccgtgttctataaaatgctggtttgcaaagtcaggtgagtggcttttggggatattaaatggaaattgggtagttgttgcagtccttgttatcatattactaatctctatctttctattcagcttcttctgccccataagatctcacaaaaagcaactttaa

SEQ ID NO: 3268 - RNA, 3408 nt, synthetic construct
  misc_feature 1..3408: note = derived and/or modified CDS sequence (wt) from DOBV(DOBV/Ano-Poroia/Afl9/1999)__NC_005234.1__GP
  source 1..3408: mol_type = other RNA
atgatcatgtggggtttactattgacaatgattttgatcgattttggggcatccttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgactagtttattttcaataatgcctggggtagcacattcaattgcaattgaattatgtgtaccagggttccatggttgggcaactgctgctcttctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacactagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcttcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataa

SEQ ID NO: 3269 - RNA, 3408 nt, synthetic construct
  misc_feature 1..3408: note = derived and/or modified CDS sequence (wt) from DOBV(DOB/Saaremaa/160V)__AJ009774.2__GP
  source 1..3408: mol_type = other RNA
atgatcatgtggggtttactattgacaatgagtttgatcaatcttggggcatccctgaggaatgtgtatgacatgaaaatagaatgtccacactccatcaattttggagaaagcagtgttacaggtaaagtggaattaccccccattctgcttactgatgcagaggctctggttcctgaaagctcctgcaatatggacaaccaccagtccttgtcaatcacacaaaaagtgacaaaggtgagttggaggaagaaggcagaccaggtccaagcagctaaggattcttttgaaactacatcaaatgagattaatctcaagggaacatgtacactgacacatagaatggttgaagaatcttaccgaaacagaaaatcagtcatatgctatgacctatcttgcaattcaacacattgtaagcctacaatgcatatgattgttcctgttcattcctgtaacatgatgaaaagctgtcttgtggggttaggaccttaccgagttcaagtcgtttatgaaagaacatactgtacaactggtatactgacagaaggaaaatgctttgtgccagatcagagtatcatcagtgtgataaaaaatggagtgtttgatatagcaagtgtcagtattgtttgcttcttcatccgagtaaagggaactagctataaaataatggcaagtataaagacatcaaatccaaacaactgcaatgatactgacaataaagttcaaggctactatctctgtattgtaggtgctaactcttctcccgtctatgcaccctcaactactgatttcagatcaacagaagcacttgctagcctactgagatctccccatggtgaagatcatgatctgtctggagaagaggttgcaacttattcaattgctgggcagattgagggcaaaatcccacatactgcaaatgcagcaaatatggcattcactgcattctcaggaatccctagctattcttcattgagtgtatttgcaggaaatcaggatggaaccataatttttagccctggcctatttcctaaactaaatcaatcttcatgtgacaaagttgctttacccttaatatgggaaggatatatagacctacctggttactatgaaacaattcatccttgcaacgtcttttgtgtcttgtctggcccaggagcatcatgtgaggcattttcagaaggtggtatattcaacataacatccccaacctgtttagtttctaaacagaacagattcagggctgcagagcagcaaattaattttgtgtgtcaaagagttgatcaagatattgtgatatattgcaatgggcagaagaaaaccatcttaacaaagacactggttatcggccagtgcatttattcagtaacgagtttattttcaataatgcccagtgtagcacactctatcgcaattgaactgtgtgtacccgggttccatggttgggccactgctgctctcttaaccacattttgctttggttggatattgatcccttcaattacactggccgtgttaattgtcttaaaattctttgctgcaattctgcacaatagttcccaagaaaatcggttcaaaataattctgagaaaaataaaggaggagtttgagaaaaccaaagggtcaatggtctgtgaagtctgtaaatatgaatgtgagacagggaaggaactcaaagcacataatttatcttgtccacagtcacagtgtccttactgctttacacattgtgaacttactgaatcagcatttcaggcacactatagagtctgtcaggctacacatagattcagggatgacttaaagaaaacaataacacctcagtcaacaagccctggttgttatcgcacattaaatctttttagatacaagagcaggtgttatatcttcacagtgtgggttgtcctcctcatcattgagtcaatcttatgggctgctagtgcatcagaacttgtactggagccaaattggaatgacaatgcacatggtgtcggtatagtcccaatgcacactgatttggagttggatttctctctcccttccagttccaagtacacgtacaaaagaaaattaacaagccctataaaccaagaacaatcaatagaccttcatattgagatagaaagtcaagggatttctacaagtgtgcatgctttaggccactggtttgatgggaggttgaacttaaaaacatccttccattgttatggtgcatgtactaaatatgaatacccttggcacacagcaaaatgtcattttgaaagggattttgagtatgaaaataattggagttgtaaccctccagactgtccaggcattggtactggctgcaccgcatgtggtttatatctggaccagcttaaacctgttggaagtgcctataaactgataacagttcgctatagtcgaaaagtgtgtgttcaatttggtgaagaaaacctttgtaaaactattgacatgaatgattgctttgtaaccaggcatgtgaaggtatgcatcataggtactgtttcaaagttctcacaaggtgacaccctagtgttccttggtcccatggaagggggaggtctaatattcaaagattggtgcacaacaacatgtcagtttggggatccaggagatatcatgagtcccaaggataagggtttcagctgtcctgattttacaggccattttagaaaaaaatgtaattttgcaactacacctgtgtgtgaatatgatggcaatatggtttctggttacaaaaaggtaatggcaaccattgattcttttcaagcatttaatactagctatatacactatactgatgagcagattgagtggaaagatcctgatgggatgcttaaagatcatttaaacatacttgttacaaaagacattgactttgaaaacctcggagaaaacccatgtagagttgggctgcaaacagcatctatagagggtgcatggggctctggagttggatttactcttacttgccagatttcactgactgaatgctcacgctttttgacatccatcaaggcatgtgatatggccatctgttatggcgcacagagtgttacacttgttagagggcagaatacagtaaaggtttctgggaagggggggcatagcggctcctcctttaagtgttgtcatggcaatgactgctctcaacaagggcttcaagcaagtgctccacatttggacaaggtcaatggcattgttgagcaagagagcacacaggtttatgatgatggtgcaccacaatgtggcatttcatgttggttcataaagtctggggagtggataaaaggtatcttcagtggaaactggattgtcattgttgtgttaattgtccttttcatactgtccttaatattactgagtttcctgtgccctatccgcaagcataagcgctcataa

SEQ ID NO: 3270 - RNA, 3408 nt, synthetic construct
  misc_feature 1..3408: note = derived and/or modified CDS sequence (wt) from DOBV(East Slovakia/400Af/98)__AY168577.1__GP
  source 1..3408: mol_type = other RNA
atgatcatgtggggtttactattgacaatgattttgatcgattttgggacatccttgaggaatgtttatgacatgaaaatagaatgcccacattcaatcaacttcggggagagcagtgtgacaggtaaggtggagctgccaccccttctgctcacagatgcagaggccttggttccagagagttcttgtaacatggataaccatcagtccatgtcaattatacaaaaagtaacaaaagtgagctggagaaaaaaagcagacaaagcccaagctgccaaggactcatttgaaacaacatcaagtgaggtcaatctaaaagggacatgtacattgagccacaggatggttgaagaatcctacaggaataggagatcagtgatatgctatgacttgtcttgtaattcaacacattgcaagccaacaatgcatatgattgtacctgtgcactcatgcaatatgatgaaaagctgcttggttggactcgggccttatcgaattcaagttgtctacgagagaacctactgtacaactggtatactaacagaaggaaaatgttttgtgccagaccaaagtatcgttaatgtcatcaaaaacggggtatttgatattgcaagtgtgagcattgtctgttttttcattagagtcaaagggacaaactacaaaataatggcaagtattaaaacggcaactgcaaataactgtaatgacactgacaataaggttcaagggtattatctttgtattgttggtgggaattcttctcctgtgtatgcaccttcaaccactgattttagatctatggaggcacttgctagccttttaagagctcctcatggtgaagaccatgatttatctggagaagaggttgcaacttattcaattgccggacagattgaaggcaaaattccacacactgcaaatgcagcaaacatgctgtttactgcattctcaggtattcctagttactcttcattaagtgtctatattggaagtcaggatgggcctgtcgtttatagcccaggattatttcctaagttgaaccaatcttcatgtgataaggttgcattaccattgatatgggaagggtatatagatctgcctggctattatgaaacagttcacccatgtaatgttttttgtgtgctgtctggcccaggggcatcatgtgaggcattttcagaaggtggtattttcaatattacatcccctacttgccttgtgtcaaagcaaaataggttcagagctgctgagcagcaagtaaattttgtgtgccagcgagttgaccaagacattgttatctactgtaatggacaaaaaaagacaattttgactaagacattagtgattgggcagtgtatttattcagtgacaagtctattttcaataatgcctggggtagcacattcaattgcaattgaattgtgtgtaccagggttccatggttgggcaactgctgctcttcttaccacattctgctttggatggatattgatcccttccattacattagctgtattggtggtcttaaagttttttgcagcaatcttacataatagctctcaagaaaaccgttttaagattatcctaagaaagattaaagaagaatttgaaaagactaaaggctcaatggtttgtgaagtgtgcaagtatgagtgtgaaacagggaaagagcttaaagcccacaatttgtcctgccctcagtcacagtgtccttattgttttacacattgtgagcctacagaatctgcctttcaggcacattataaagtgtgccaggcaacacacagatttagggatgatttgaagaagacaataacacctcagtctacaagccctgggtgttatcggacattaaatctctttagatataaaagtaggtgttacatctttacagtatgggtaaccctgctaatcattgaatcaatcatgtgggcagctagtgcatcagaaaatgtcttagaaccaagctggaatgacaatgcacatggtgttggtgttgtcccaatgcatactgacctggaactagatttttcccttccatcaagctctaagtatacatataaaagaaaattgacaagtccattaaatcaagaacaatcagttgatcttcacatagagatagaaagtcaggggatttccacaagtgttcatgcattaggacattggtttgatgggaggcttaacttaaagacatcttttcattgttatggtgcatgtactaagtatgaatacccctggcatacagcgaaatgtcactttgaaagagacttcgagtatgagaacagttggggctgtaatcctgctgattgccctgggattggtactggttgtactgcatgcggactatatattgaccagcttaaacctgtaggcagtgcatataagctgatcacagtccgttacagccgtaaagtatgtgttcaatttggtgaagaaaacctatgcaagacaattgacatgaatgattgctttgtcacaagacatgtcaaagtatgcatcataggcacagtttcaaaattttcacaaggtgatactctagtattcctgggtcctatggaaggtgggggcttgatatttaaggattggtgcactagtacatgtcaattcggtgatccaggagatattatgagtcccaaagataaaggtttcagctgccctgattttacaggccatttccggaaaaaatgcaacttcgcaacaacacctgtgtgcgagtatgatggcaacatggtctccgggtataagaaagtaatggcaaccattgattcctttcaatcatttaacactagttcaattcattatacagatgaaaggattgaatggaaagaccctgatggaatgctcaaggaccaccttaatatacttgtcacaaaggatattgacttcgaaaaccttggggagaacccgtgcaaggtaggactccaaacatcatcaatagaaggtgcatggggttctggggttggtttcaccctcacttgccaaatctcactgactgaatgttcacgctttctaacatcaattaaagcatgtgacatggcaatttgttatggtgcacaaagtgttacactcatcagaggccaaaatacagtaaaggtttccgggaaaggtgggcatagtggctcttcattcaagtgttgccatggaacagattgctctcaacaagggctgcaagcaagtgcaccacacctggataaagtcaatgggattgttgaacaagagagtgaaaaagtgtatgatgatggtgcaccacagtgtggcatttcatgctggtttgttaagtctggagagtggataacaggaattttcaatgggaattggattgtcatagttgtgcttatttttttcttcatactatccctaattttgcttagtcttttgtgtcccattcgtaagcataagcgttcataa

SEQ ID NO: 3271 - RNA, 3408 nt, synthetic construct
  misc_feature 1..3408: note = derived and/or modified CDS sequence (wt) from DOBV(East Slovakia/862Aa/97)__AY168578.1__GP
  source 1..3408: mol_type = other RNA
atgatcatgtggggtttactattgacaatgagcctgatcaatcttggggcatccctgaggaatgtgtatgacctcagaatagagtgtccacactcaatcaactttggagagagcagtgtaacaggtaaggtggaattaccccccatcccacttactgatgcagagacgttagtccctgaaagctcctgcaacatggacaaccaccagtcattatcgatcacacaaaaagtgacaaaggtaagttggagaaaaaaagcagacaaagttcaggcagccaaggattcatttgaaaccacatcaagtgaaatcaatcttaaagggacatgcacactggcacataggatggttgaagaatcttacaggaacagaaagtcagtcatatgctatgacttatcctgtaattcaacacactgtaaaccaacaatgtatatgattgttcctgtccattcatgcaatatgatgaaaagctgccttgtgggtttaggaccttaccggattcaggttgtttatgagagaacatactgcacaactggtatattgatagagggcaagtgctttgtaccagaccagagcattatcagtgtgataaaaaatggggtttttgatattgcaagtgtcagtattgtctgcttcttcattcgcataaagggaaacagctataagataatgacaaatataaaaacagcaaatccaaacaactgtaatgatactgacaataaagtacagggttattatctctgcattgtaggagctaactcttcccctgtttatgcaccctcaaccactgattttaggtcaatggaggtacttgccagtctgctgagatctccccatggtgaagaccatgatctgtccggtgaggaagttgcaacttattcaattgccggtcaggttgagggcaaagttccgcacactgaaaatgcagcaaatatgctatttactgcattttcaggaatccctagctactcttcactgagtgtatttgctggaaatcaagacggaactgtaatctacagccctggtttgttccctaaattaaaccaatcctcatgtgagaaagttgcattgcccttgatatgggaaggatatatagacttgcctggctactatgaaacaattcacccttgcaatgtcttctgtgttttgtccggcccaggggcatcctgtgaggcattttcagaaggtggcatcttcaatataacatccccgacatgtttggtttcaaaacagaatcggttcagggctgcagagcaacagattaactttgtgtgccagcgagttgatcaagacattgtgatttactgcaatggacagaagaagaccattttgacaaagacactagtgattggacaatgcatctactcagtaacaagcctgttttcaattatgcccggtgtagcacattctattgcaattgaattatgtgtacctggttttcatggatgggctactgctgctctcctgaccacattttgcttcggttggatactaatcccttctatcacactagctatactgattgtcttaaagttctttgctgcaatcctacacaacagttctcaagaaaatcggtttaaagtcattttgagaaagataaaggaagagtttgaaaaaactaaaggctcaatggtatgtgaagtgtgtaaatatgaatgtgaaacaggaaaggaactcaaagcacacaatttatcctgcccacaatcacagtgtccatactgttttacacactgtgaactcacggaatccgcatttcaggcacactatagagtctgccaggctacacatagatttagggatgacttgaagaaaacaataacacctcagtcaacaagtccaggttgctatcgcacactaaatctttttagatataagagcaggtgttatatttttactgtctgggtggttcttctcatcattgaatcaattctttgggctgccagtgcatcagagattgtcttggaaccaagttggaatgataatgcacatggtgttggtgttgtcccaatgcacaccgatttggaactggatttttctcttccatcaagctccaaatacacatacaagagaaaattgacaagtcccattaatcaagaacaatcagtagaccttcatattgagatagaaagtcaaaggatttctacaagtgtgcatgctttaggccattggtttgatggaagattaaacttaaaaacatcctttcattgctatggtgcatgcaccaaatatgaatatccctggcacacagcgagatgtcattttgaaagggactttgagtatgaaaacagttggagttgtaaccctgcagactgtccaggcataggtactggctgcactgcatgtggtctataccttgaccagctcaagcctgtcgggagtgcttataaattgattacagttcgttacagtaggaaagtgtgtgttcaatttggtgaagaaaacctttgtaaaatcattgatatgaatgattgctttgtatcacggcatgtgaaagtatgcattataggtactgtttcaaagttctcacaaggtgacaccctggtgtttcttggtcccatggagggtggaggtttaatatttaaggattggtgcacaacaacatgtcagtttggtgatcctggggacataatgagtcccaaggataaaggttttagctgtcctgatttcacaggtcatttcaggaaaaaatgtaattttgccactacccctgtgtgtgagtatgatggcaatatggtttctggatacaaaaaagtaatggcaactattgattcttttcaagcattcaacactagctacatacattatactgatgaacggattgagtggaaagacccggatgggatgcttaaagaccatataaacatacttgttacaaaggacattgattttgaaaatcttggagaaaacccatgtaaagttgggctgcaaacagcatctatagagggtgcatggggttctggagttgggtttacccttacctgccagatctcattaactgaatgttcacgctttttaacatctattaaggcatgtgatatggccatttgctatggggcgcagagtgttacacttgttagaggacagaacacagtgaaggtatctgggaaaggtggacatagtggatcctccttcaagtgctgtcatggtactgattgctcccagcaagggcttcaagcaagtgctccgcacctggataaggtcaacggtattgttgagcaagagagcacacaagtgtatgatgatggtgcacctcaatgtggaatttcttgctggtttataaaatctggagagtggataaagggtatcttcaatggaaactggattgttattgttgtgttgattttcttcttcatattgtctttgatattactcagttttctatgccctatccgtaaacacaagcgttcctaa

SEQ ID NO: 3272 - RNA, 3408 nt, synthetic construct
  misc_feature 1..3408: note = derived and/or modified CDS sequence (wt) from DOBV(A35)__GU904036.1__GP
  source 1..3408: mol_type = other RNA
atgatcatgtggggtttactattgacactgagcctgatcagtcttggggcatccctgaggaatgtgtatgacctcagaatagagtgtccacactcaatcaactttggagagagcagtgtaacaggtaaggtggaattaccccccatcccacttactgatgcagagacgttagtccctgaaagctcctgcaacatggacaaccaccagtcattatcaattacacaaaaagtgacaaaggtgagttggagaaaaaaagcagacaaagttcaggcagccaaggattcatttgaaaccacatcaagtgaaatcaatcttaaagggacatgcacactggcacataggatggttgaagaatcttacaggagcagaaagtcagtcatatgctatgacttatcctgtaattcaacacactgtaaaccaacaatgtatatgattgttcctgtccattcatgcaatatgatgaaaagctgccttgtgggtttaggaccttaccggattcaggttgtttatgaaagaacatactgcacaactggtatattgatagagggcaagtgctttgtaccagaccagagcattattagtgtgataaaaaatggggtttttgacattgcaagtgtcagtattgtctgcttcttcattcgcataaagggaaacagctataagataatgacaaatataaaaacagcaaatccaaacaactgtaatgatactgacaataaagtacagggttattatctctgcattgtaggagccaactcttcccctgtttatgcaccctcaaccactgattttaggtcaatggaggtacttgccagcctgctgagatctcctcatggtgaagaccatgatttgtctggtgaggaagttgcaacttattcaattgctggtcaggttgagggcaaagttccgcacactgaaaatgcagcaaatatgctatttactgcattctcaggaatccctagctactcttcactgagtgtatttgctggaaatcaagacggaactgtaatctatagccctggtttgttccctaaattaaaccaatcctcatgtgaaaaagttgcattgcctttgatatgggaaggatatatagacttgcctggctactatgaaacaattcacccttgtaatgtcttctgtgttttgtctggcccaggggcatcctgtgaggcattttcagaaggtggtatcttcaatataacatccccgacatgtttggtttcaaaacagaatcggttcagggctgcagagcaacagattaactttgtgtgccagcgagttgatcaagacattgtgatttactgcaacggacagaagaagaccatcctgacaaagacactagtgattggacaatgcatctactcagtaacaagcctgttttcaattatgcccggtgtagcacattctattgcaattgaattatgtgtacctggttttcatggatgggctactgctgctctcctgaccacattttgcttcggttggatactaatcccttctatcacactagctatactgattgtcttaaagttttttgctgcaatcttgcacaacagttctcaagaaaatcggtttaaagtcattttgagaaagataaaggaggagtttgaaaaaactaaaggctcaatggtatgtgaagtgtgtaaatatgaatgtgaaacaggaaaggaactcaaagcacacaatttgtcctgcccacaatcacagtgtccatactgctttacacactgtgaactcacggaatctgcatttcaggcacactatagagtctgccaggctacacatagatttagggatgacttgaagaaaacaataacacctcagtcaacaagtccaggttgctatcgcacactaaatctttttagatataagagcaggtgttatatttttactgtctgggtggttcttcttatcattgaatcaattctttgggctgccagtgcatcagagattgtcttggaaccaagttggaatgataatgcacatggtgttggtgttgtcccaatgcacaccgatttggaattggatttttctcttccatcaagctccaaatacacatacaagagaaaattgacaagtcccattaaccaagaacaatcagtagaccttcatattgagatagaaagtcaaaggatttctacaagtgtacatgctttaggccattggtttgatggaagattgaacttaaaaacatcctttcattgctatggtgcatgcaccaaatatgaatatccctggcacacagcaagatgtcattttgaaagggactttgagtatgaaaacagttggagttgtaaccctgcagactgtccaggcataggtactggctgcactgcatgtggtctataccttgaccagctcaagcctgttgggagtgcttataaattgattacagttcgttacagtaggaaagtctgtgttcaatttggtgaagaaaacctttgtaaaatcattgatatgaatgattgctttgtatcaaggcatgtgaaagtatgcattataggcactgtttcaaagttctcacaaggtgacaccctggtgtttctcggtcccatggagggtggaggtttaatatttaaggattggtgcacaacaacatgtcagtttggtgatcctggggatataatgagtcccaaggataaaggttttagctgtcctgatttcacaggtcatttcaggaaaaaatgtaactttgctactacccctgtgtgtgagtatgatggcaatatggtttctggatacaaaaaagtaatggcaactattgattcttttcaagcattcaacaccagctacatacattatactgatgaacggattgagtggaaagacccggatgggatgcttaaagaccatataaacatacttgttacaaaggacattgattttgaaaatcttggagaaaacccatgtaaagttgggctacaaacagcatctatagagggtgcatggggttctggagttgggttcacccttacctgccagatctcattaactgaatgttcacgcttcttaacgtctattaaggcatgtgatatggccatttgctatggggcgcagagtgttacacttgttagaggacagaatacagtgaaggtatctgggaaaggtggacatagtggatcctccttcaagtgctgtcatggtactgactgctcccagcaagggcttcaagcaagtgctccgcacctggacaaggtcaacggtattgttgagcaagaaagcacacaagtatatgatgatggtgcacctcaatgtggaatctcttgctggtttataaaatctggagagtggataaagggtatctttaatggaaactggattgttattgttgtgttaattttcttcttcatattgtctttgatattactcagttttctatgccctatccgtaaacacaagcgctcctaa

SEQ ID NO: 3273 - RNA, 3408 nt, synthetic construct
  misc_feature 1..3408: note = derived and/or modified CDS sequence (wt) from DOBV(A6)__GU904033.1__GP
  source 1..3408: mol_type = other RNA
atgatcatgtggggtctactattgacaatgattttgatcgattttggggcatccttaaggaatgtttatgacatgaagatagaatgcccacattcaatcaactttggggagagcagtgtaacaggtaaggtggaattaccaccccttctgctcacagatgcagaggccttggtcccggagagttcttgtaacatggacaaccatcagtctatgtcaattatacaaaaagtgacaaaagtgagttggagaaaaaaggcagacaaagcccaagctgccaaggactcatttgagacaacatcaagcgaggttaatctgaaggggacatgcacattgagtcataggatggttgaagaatcctacaggaataggagatcagtgatatgctatgacttgtcttgcaattcaacacattgtaagccaacgatgcatatgattgtgcctgtgcactcatgcaacatgatgaaaagctgtctggttgggcttgggccttatcgaatccaagttgcctatgaaagaacctactgtacaactggtatactaacagaagggaagtgttttgtgccagaccagagtattgtcagtgtcatcaagaatggggtttttgacattgcaagtgtgagcattgtctgtttttttatcagagttaaaggaactaactacaagataatggcgagtattaaaacagcaactgcaaataactgtaatgacactgacaataaggttcaaggatattacctttgtattgttgggggaaattcttctcctgtgtatgcaccttcaaccactgattttagatctatggaagcacttgctagccttttaagagctcctcatggtgaggaccatgatttatctggagaagaggttgcaacttattcaattgccgggcaaattgaaggcaaaatcccacatactgcaaatgcagcaaacatgctatttactgcattctcaggaattcctagttactcttcattgagtgtttttattggaagtcaagatgggcctattatttatagcccaggattgtttcccaagttgaaccaatcttcatgtgataaggtcgcactaccattgatatgggaagggtacatagatctacctggctattatgaaacagttcacccgtgtaatgtcttttgtgtgctatctggcccaggagcatcatgtgaggcattctcagaaggtggtattttcaatattacatcccctacatgccttgtgtcaaagcaaaatcggttcagggcagctgagcagcaagtcaatttcgtatgccagcgagtcgaccaagacattattatctactgtaatggacaaaagaagacaattttgaccaagacattagtgattgggcagtgtatttattcagtgactagtttgttttcaataatgcctggggtagcacattcaattgcaatcgaattatgtgtacccgggttccatggctgggcaactgctgctcttctcaccacattctgctttggctggatactgatcccttccatcacattggctgtattggttgtcttaaagttttttgcagcaatcttacataatagctctcaagaaaaccgttttaaaattatcctaaggaagattaaagaagaatttgaaaagactaagggctcaatggtttgtgaagtgtgcaagtatgagtgtgaaacagggaaggagcttaaagcccataatttgtcttgccctcagtcacagtgtccttattgctttacacattgtgagcctacagaatctgccttccaggcacattataaagtgtgccaggcaacacacaggtttagagatgatttgaagaaaacaataacacctcaatctacaagcccgggttgttaccggacattaaatctctttaggtataaaagtaggtgttacatttttacagtgtgggtcaccctgctaatcattgaatcaatcatgtgggcagctagcgcatcagaaaatgttttggagccaagctggaatgacaacgcacatggtgttggtgttgtcccaatgcatactgatctggaactagatttttctcttccgtcaagttctaagtacacatataaaagaaaactgacaagtccattaaatcaagaacaatcagtagatcttcacatagagatagagagtcaagggatttctacaagtgttcatgcattaggtcattggtttgatgggagacttaatttaaagacatcttttcattgttatggtgcatgtactaagtatgaatatccttggcatacagcaaaatgccactttgaaagggatttcgagtatgagaacagctggggctgtaatcctgctgattgccctgggattggtacgggctgtactgcatgcggactatacattgaccaacttaaacctgtaggcagtgcatacaagctaatcacagtccgttacagccgtaaagtatgtgttcagtttggtgaagaaaacctatgtaagacaattgacatgaatgattgctttgttacaagacatgtcaaagtatgcattataggtacagtttcaaagttctcacaaggtgataccctagtattcctgggccctatggtaggtgggggcttaatatttaaggattggtgcactagcacatgccaatttggtgatcctggggacattatgagtcctaaagacaaagggtttagctgccctgacttcacaggccacttccggaaaaaatgcaactttgcaacaacacctgtatgcgagtatgatggtaatatggtctctgggtataagaaagtaatggcaactattgattcctttcagtcatttaacactagctcaattcattacacagatgaaaggattgaatggaaggaccctgatgggatgcttaaggaccatctcaatatacttgtcacaaaagacattgactttgaaaaccttggggagaacccgtgcaaagtagggcttcaaacatcatcaatagaaggtgcatggggctctggggttggtttcacccttacttgtcaaatctcactgacagaatgttcacgctttctgacatccattaaagcatgtgacatggcaatctgttatggtgcacaaagtgtcacactcattagaggccaaaatacagtgaaggtttccgggaagggtgggcatagtggctcttcattcaagtgttgtcatgggacagattgctctcagcaggggctacaagcaagcgcaccacacctagacaaagtcaatggaattgttgaacaagatagtgaaaaagtctatgatgatggtgcaccacaatgtggcatttcatgctggtttgttaagtctggggagtggataacaggaatctttaatggaaactggattgtcattgttgtgcttgtttttttcttcatactatccttaatcttacttagtcttttatgccccattcgtaagcataagcgctcataa

SEQ ID NO: 3274 - RNA, 3408 nt, synthetic construct
  misc_feature 1..3408: note = derived and/or modified CDS sequence (wt) from DOBV(B13)__GU904034.1__GP
  source 1..3408: mol_type = other RNA
atgatcatgtggggtctactattgacaatgattttgatcgattttggggcatccttaaggaatgtttatgacatgaagatagaatgcccacattcaatcaactttggggagagcagtgtaacaggtaaggtggaattaccaccccttctgctcacagatgcagaggccttggtcccggagagttcttgtaacatggacaaccatcagtctatgtcaattatacaaaaagtgacaaaagtgagttggagaaaaaaggcagacaaagcccaagctgccaaggactcatttgagacaacatcaagcgaggttaatctgaaggggacatgcacattgagtcataggatggttgaagaatcctacaggaataggagatcagtgatatgctatgacttgtcttgcaattcaacacattgtaagccaacgatgcatatgattgtgcctgtgcactcatgcaacatgatgaaaagctgtctggttgggcttgggccttatcgaatccaagttgtctatgaaagaacctactgtacaactggtatactaacagaagggaagtgttttgtgccagaccagagtattgtcagtgtcatcaagaatggggtttttgacattgcaagtgtgagcattgtctgtttttttatcagagttaaaggaactaactacaagataatggcgagtattaaaacagcaactgcaaataactgtaatgacactgacaataaggttcaaggatattacctttgtattgttgggggaaattcttctcctgtgtatgcaccttcaaccactgattttagatctatggaagcacttgctagccttttaagagctcctcatggtgaggaccatgatttatctggagaagaggttgcaacttattcaattgccgggcaaattgaaggcaaaatcccacatactgcaaatgcagcaaacatgctatttactgcattctcaggaattcctagttactcttcattgagtgtttttattggaagtcaagatgggcctattatttatagcccaggattgtttcccaagttgaaccaatcttcatgtgataaggtcgcactaccattgatatgggaagggtacatagatctacctggctattatgaaacagttcacccgtgtaatgtcttttgtgtgctatctggcccaggagcatcatgtgaggcattctcagaaggtggtattttcaatattacatcccctacatgccttgtgtcaaagcaaaatcggttcagggcagctgagcagcaagtcaatttcgtatgccagcgagtcgaccaagacattattatctactgtaatggacaaaagaagacaattttgaccaagacattagtgattgggcagtgtatttattcagtgactagtttgttttcaataatgcctggggtagcacattcaattgcaatcgaattatgtgtaccagggttccatggctgggcaactgctgctcttctcaccacattctgctttggctggatactgatcccttccatcacattggctgtattggttgtcttaaagttttttgcagcaatcttacataatagctctcaagaaaaccgttttaaaattatcctaaggaagattaaagaagaatttgaaaagactaagggctcaatggtttgtgaagtgtgcaagtatgagtgtgaaacagggaaggagcttaaagcccataatttgtcttgccctcagtcacagtgtccttattgctttacacattgtgagcctacagaatctgccttccaggcacattataaagtgtgccaggcaacacacaggtttagagatgatttgaagaaaacaataacacctcaatctacaagcccgggttgttaccggacattaaatctctttaggtataaaagtaggtgttacatttttacagtgtgggtcaccctgctaatcattgaatcaatcatgtgggcagctagcgcatcagaaaatgttttggagccaagctggaatgacaacgcacatggtgttggtgttgtcccaatgcatactgatctggaactagatttttctcttccgtcaagttctaagtacacatataaaagaaaactgacaagtccattaaatcaagaacaatcagtagatcttcacatagagatagagagtcaagggatttctacaagtgttcatgcattaggtcattggtttgatgggagacttaatttaaagacatcttttcattgttatggtgcatgtactaagtatgaatatccttggcatacagcaaaatgccactttgaaagggatttcgagtatgagaacagctggggctgtaatcctgctgattgccctgggattggtacgggctgtactgcatgcggactatacattgaccaacttaaacctgtaggcagtgcatacaagctaatcacagtccgttacagccgtaaagtatgtgttcagtttggtgaagaaaacctatgtaagacaattgacatgaatgattgctttgttacaagacatgtcaaagtatgcattataggtacagtttcaaagttctcacaaggtgataccctagtattcctgggccctatggtaggtgggggcttaatatttaaggattggtgcactagcacatgccaatttggtgatcctggggacattatgagtcctaaagacaaagggtttagctgccctgacttcacaggccacttccggaaaaaatgcaactttgcaacaacacctgtatgcgagtatgatggtaatatggtctctgggtataagaaagtaatggcaactattgattcctttcagtcatttaacactagctcaattcattacacagatgaaaggattgaatggaaggaccctgatgggatgcttaaggaccatctcaatatacttgtcacaaaagacattgactttgaaaaccttggggagaacccgtgcaaagtagggcttcaaacatcatcaatagaaggtgcatggggctctggggttggtttcacccttacttgtcaaatctcactgacagaatgttcacgctttctgacatccattaaagcatgtgacatggcaatctgttatggtgcacaaagtgtcacactcattagaggccaaaatacagtgaaggtttccgggaagggtgggcatagtggctcttcattcaagtgttgtcatgggacagattgctctcagcaggggctacaagcaagcgcaccacacctagacaaagtcaatggaattgttgaacaagatagtgaaaaagtctatgatgatggtgcaccacaatgtggcatttcatgctggtttgttaagtctggggagtggataacaggaatctttaatggaaactggattgtcattgttgtgcttgtttttttcttcatactatccttaatcttacttagtcttttatgccccattcgtaagcataagcgctcataa

SEQ ID NO: 3275 - RNA, 3408 nt, synthetic construct
  misc_feature 1..3408: note = derived and/or modified CDS sequence (wt) from DOBV(Aa1854/Lipetsk-02)__EU188453.1__GP
  source 1..3408: mol_type = other RNA
atgatcatgtggggtttattattgacaatggctttgatcaatcctggggcaaccctaaggaatgtgtatgacatgagaatagaatgtccacactcaattaattttggggagagtagtgtaacaggtaaagtggaactaccacctattccacttgctgatgcagagactttggttcctgagagctcttgcaatatggacaatcatcagtctttatcaattacacagaaagtgacaaaggtaagctggagaaaaaaagcagataaagttcaagcagccaaggattcatttgaaaccacatcaagtgagattaatctcaaaggaacatgcacattgacacataggatggtggaagaatcctatagaaataggaaatcagtcatatgctatgacttgtcctgtaattcaacacactgtaaaccaacaatgcatatgattgttcctgtccattcatgcaatatgatgaaaagctgtcttgtaggattaggaccttaccggattcaagttgtttatgaaagaacatactgcacaactggtatattgacagagggaaaatgttttgtaccagaccaaagtattgttagtgtaataaagaacggggtatttgacattgcaagtgtgagtattgtttgcttctttatccggataaagggaaatagttacaaaataatggcaagcataaaagaggcaaacccaaacaactgtaatgacactgacaataaagtgcagggctattacctttgcattgtaggagctaattcttctcctgtctatgcaccctcaaccactgatttcagatcagtggaagcacttgccagtttattgagatctccccatggtgaagaccatgatctatctggagaagaggttgcaacttattcaattgctggccaagtggaaggcaaagtcccacacactgcaaatgcagcaaatatgttatttactgcattttcaggaattcctagtcattcttcatttagtgttttcactgggaaccaggatggaactgtgatctatagcccagggttatttcccaaattaaaccaatccgcatgcgataaagttgcactacctttaatatgggaaggatatatagacttgcctggctactatgaaacaattcacccatgtaatgtattttgtgttctatctggtccaggggcatcatgtgaggcattttctgaaggtggcatctttaacatcacatccccaacctgcttggtatcaaagcaaaaccgattcagggctgcagagcagcaaattaattttgtatgtcagcgagttgaccaagacattgtgatctattgtaatggacagaaaaaaaccatcttaacaaagacattggtgattggacagtgtatttactcagtgacaagcctattttcaataatgcctggggtagcacattctattgcaattgaactatgtgtaccagggttccatggctgggccactgctgccctcctgacaacattttgctttggctggatattgatcccatctatcacattggccatattaattgtcttgaaattctttgctgcaatcttgcacaacagttcccaggagaatcggttcaaaatcatcctgagaaaaataaaggaagaatttgagagaacaaaaggatcaatggtttgtgaagtatgtaaatatgaatgtgaaacaggaaaggaactcaaagcacacaatttgtcctgcccacaatcacaatgtccatactgctttacacactgtgagctcacagaatcagcatttcaggcacactatagggtttgccaggctacacatagattcagggatgacttgaaaaaaacaataacacctcaatcaactagccctggttgctaccgtacgctgaatctctttagatacaaaagtagatgttatattttcacagtgtgggtagttctccttatcattgaatcaattttgtgggctgctagtgcatcagaaactgtcttagaaccaaactggaatgacaatgcacatggtgttggtgtggtgccaatgcatactgacttggaactggatttttcccttccttcaagctctaaatatacatacaagagaaaactaacaagcccaataaaccaagaacaatcagtagacctccatattgaggtagaaagccaagggatttcaacaagtgtacatgctttaggccactggtttgatggtaggttaaacttaaagacatccttccattgctacggtgcatgcacaaaatatgaatacccttggcatacagcaaggtgtcactttgagagggactttgagtatgaaaacagttggagctgtaaccctgcggattgcccaggtatcggtactggttgtactgcatgtgggttatatcttgaccagctaaagcctgtcggaagtgcttataaactgatcacagttcgttatagtaggagagtatgtgttcagtttggtgaagagaacctctgtaaaaccattgacatgaatgattgttttgtgactagacatgtgaaagtgtgcattataggcacagtctcaaagttctcacagggtgataccctagtgttccttggtcccatggagggtggaggtttaatattcaaggactggtgcacaacaacatgccagtttggggacccaggtgacattatgagtccgaaagataagggttttagctgtcctgacttcacaggccatttcagaaaaaaatgcaactttgctactacacctgtgtgtgagtatgatgggaatatggtctctggctataagaaggtgatggcaactattgattcttttcaagcattcaatactagcaatattcactatactgatgaaaggattgagtggaaggacccagatgggatgcttaaagaccatttaaacatacttgttacaaaggacattgactttgaaaatcttggagagaacccatgtaaagtcgggttacagacagcatcaatagagggtgcatggggttctggagttgggttcactcttacttgccagatctccttaactgaatgttcacgcttcttgacatccatcaaagcatgtgatatggccatttgctatggtgcacagagtgtcacacttgttagaggccaaaatacagtaaaggtctctggaaagggtggacatagcggatcttcatttaagtgttgtcatggtactgactgttctcaacaagggcttcaagcaagtgctccacatttggacaaggttaatggcattgttgaacaagagagcacacaagtgtatgatgatggtgcacctcaatgtggcatttcatgttggttcataaagtctggagaatggataaagggtatctttaatgggaactggattgtcattgttgtactaatctttttcttcatattatctctgatattacttagtttcctatgccctatccgtaaacataagcgctcataa

SEQ ID NO: 3276 - RNA, 3402 nt, synthetic construct
  misc_feature 1..3402: note = derived and/or modified CDS sequence (wt) from DOBV(Ap/Sochi/hu)__JF920149.1__GP
  source 1..3402: mol_type = other RNA
atgtggggtttactattgacaatgattttgatcgatttcggggcaacccttaggaatgtctatgacatgaggatagaatgcccacattctgtcaacttcggggaaagcagtgtatcagggaaagtggagctaccaccagttctacttagtgaggtagagacgcttgtcccagaaagctcttgcaatatggataatcaccaatcaatgtcaatcatacaaaaagtcactcaactaacttggagaaagaaggctgataaagcgcaggcagcaaaagactcattcgaaattacctcaggtgaagtcagcttgaaaggtacatgcaccttaacacatagaatggttgaggactctcataggaatagaaagtcaataatatgttatgacctatcctgtaattcaacccattgtaaaccaacaatgcacatgatagttcccattcactcatgtaatatgatgaagagctgcctggtaggccttggaccttaccgcatccaggttgtttatgaaagaacatactgcacaactggtatcctaacggaaggaaaatgctttgtccctgatcagagcattgtgaatgtcataaaaaatggtgtgtttgatattgccagtgttagtattgtttgcttcttcgtgagagtgaagggtacaaattacaagataatggctagcatcaaaacagctacatcaaataattgtaatgacactggcaataaagtgcaggggtattatctgtgtattgtgggtggaaattcttcaccagtgtatgtaccatcaactactgatttccgttcaatggaagcacttgcaagtatgcttagagcaccccatggtgaagatcatgatttagctggagaagaagttgcaacatattcaattgctggtcaagttgaaggtaaagtcccccacactgcaagtacagcaaacatgctcctcactgcattctcaggcattcctagctattcttcactcagcgtcttcactggcagtcaggatggccctattgtatatagtcctggattgtttcctaaactgaaccaatcatcatgtgataaggttgggctgcctctaatatgggaaggttacattgacttgccaggttactatgaaacagtacatcagtgcaatgttttctgtgttctttcaggccctggagcatcatgtgaggcattctcagagggtggaatattcaacataacatctccaaactgtatggtctctaaacaaaataggttccgggctgctgaacaacaggttaactttgcatgccaaagggttgaccaggacattttaatcttctgtaatggtcagaagaaaacaatcctgacaaaaacattagtcattggtcaatgtatctactcaataacaagtttattttcaatcatgccaggtgtagcacattcaattgcaattgaattatgtgtgccaggtttccatgggtgggcaacagctgccctcctcacaacattctgctttggttgggtattaatcccatctattaccttggctgtacttgttgtcttaaagttttttgctgcaatcttacacaatagttcccaggaaaaccggttcaagctcatcttgaaaaagatcaaggaagagtttgaaaaaacaaagggttcaatggtttgtgaggtatgcaagtatgagtgtgagacagggaaggaattaaaagcacataatctatcctgcccgcaatcacagtgtccctattgtttcacacactgtgaaccaactgagtcagcatttcaagctcattataaggtgtgccaggcaacacatagatttagagatgatctgaaaaagactataacacctcaatctactagccctgggtgttaccggaccttgaacttgttcaggtacaaaagtaggtgttatatattcacagtgtgggtagttctccttgttgtagagtcagtgatgtgggcagccagtgcttcagagacagtattagagccctcatggaatgataacgcacatggagttggtgtagtgcctatgcatacagacttggaattagatttttctctcccatcaagctcgaagtatacgtataaaagaaagctaacgagccctataaatcaggaacaatctgttgacctacacattgagatagagagccaaggaatttctacaagtgtccatgctttaggccattggtttgatggtaggttaaacctaaagacatcatttcactgttacggtgcctgtacaaagtatgaatacccttggcatactgcaagatgtcactttgaaagagattttgagtatgagaatagttggggttgtaatccagctgactgccctggtattggtacaggttgtacagcatgtggcatctatatcgaccagttgaagcctgtgggcagtgcatacaagctgattacagtccgttatagccgcaaagtctgtgtccagtttggagaggaaaacttatgtaaaactattgacatgaatgactgttttgtcacaaggcatgtgaaagtctgtattattgggacagtctcaaaattctctcaaggggacacactggtatttttaggtcctatggagggtggagggctaatatttaaagactggtgtacaagcacatgtcagtttggagatccaggagacattatgagtcccaaggataagggatttagttgtccagaattcactggtcacttccgcaaaaagtgcaactttgcaacgacacctgtatgtgaatatgatgggaatatggtatctggatataagaaggtcatggcaactattgattcttttcaagcatttaacacaagttctatccattacacagatgagcggattgaatggaaagatccagatgggatgttgaaggaccatcttaatatattggttacaaaagatattgattttgaaaaccttggagacaatccgtgtaaggtgggacttcagactgtttccattgaaggtgcatggggttcaggggttgggttcactttaacatgccaggtttctttaactgaatgctctcgtttcttgacctcaatcaaagcttgtgacaaggcaatatgctatggcgcacagagtagcaccctcattcgaggacaaaatacagtaaaagtgtctgggaagggaggacatagtggttcatcctttaagtgttgccatggaactgattgctcacagcaaggattgcaagctagtgcaccccatcttgacaagattaatggtattgtagaacaagaaaatgaaaaagtttatgacgatggtgcaccacagtgtggtatttcatgctggtttgtgaagtctggagaatggattcaaggtatcttcaatgggaattggattgtaattgttgtcctaatctttttcttcatcctatcattgatattgctcagcatcttttgtccaattcgaaagcataaacgctcctag

SEQ ID NO: 3277 - RNA, 3402 nt, synthetic construct
  misc_feature 1..3402: note = derived and/or modified CDS sequence (wt) from DOBV(Ap1584/Sochi-01)__EU188450.1__GP
  source 1..3402: mol_type = other RNA
atgtggggtttactattgacaatgattttgatcgatttcggggcaacccttaggaatgtctatgacatgaggatagaatgcccacattctgtcaacttcggggaaagcagtgtatcagggaaagtggagctaccaccagttctacttagtgaggtagagacgcttgtcccagaaagctcttgcaatatggataatcaccaatcaatgtcaatcatacaaaaagtcactcaactaacttggagaaagaaggctgataaagcgcaggcagcaaaagactcatttgaaattacctcaggtgaagtcagcttgaaaggtacatgcaccttaacacatagaatggttgaggactctcataggaatagaaagtcaataatatgttatgacctatcctgtaattcaacccattgtaaaccaacaatgcacatgatagttcccattcactcatgtaatatgatgaagagctgcctggtaggccttggaccttaccgcatccaggttgtttatgaaagaacatactgcacaactggtatcctaacagaaggaaaatgctttgtccctgatcagagcattgtgaatgtcataaaaaatggtgtgtttgatattgccagtgttagtattgtttgcttcttcgtgagagtgaagggtacaaattacaagataatggctagcatcaaaacagctacatcaaataactgtaatgacactggcaataaagtgcaggggtattatctgtgtattgtgggtggaaattcttcaccagtgtatgtaccatcaactactgatttccgttcaatggaagcacttgcaagtatgcttagagcaccccatggtgaagatcatgatttagctggagaagaagttgcaacatattcaattgctggtcaagttgaaggtaaagtcccccacactgcaaatgcagcaaacatgctcctcactgcattctcaggggttcctagctattcttcactcagcgtcttcactggcagtcaggatggccctattgtatatagtcctggattgtttcctaaactgaaccaatcatcatgtgataaggttgggctgcctctaatatgggaaggttacattgacttgccaggttactatgaaacagtacatcagtgcaatgttttctgtgttctttcaggccctggagcatcatgtgaggcgttctcagagggtggaatattcaacataacatctccaaactgtatggtctctaaacaaaatagattccgggctgctgaacaacaggttaactttgcatgccaaagtgttgaccaggacattttaatcttctgtaatggtcagaagaaaacaatcctgacaaaaacattagtcattggtcaatgtatctacccaataacaagtttattttcaatcatgccaggtgtagcacattcaattgcaattgaattatgtgtgccaggtttccatgggtgggcaacagctgccctcctcacaacattctgctttggttgggtattaatcccatctattaccttggctgtacttgttgtcttaaagttttttgctgcaatcttacacaatagttcccaggaaaaccggttcaagctcatcttgaaaaagatcaaggaagagtttgaaaaaacaaagggttcaatggtttgtgaggtatgcaagtatgagtgtgagacagggaaggaattaaaagcacataatctatcctgcccgcaatcacagtgtccctattgtttcacacactgtgaaccaactgagtcagcatttcaagctcattataaggtgtgccaggcaacacatagatttagagatgatctgaaaaagactataacacctcaatctactagccctgggtgttaccggaccttgaacttgttcaggtacaaaagtaggtgttatatattcacagtgtgggtagttctccttgttgtagagtcagtgatgtgggcagccagtgcttcagagacagtattagagccctcatggaatgataacgcacatggagttggtgtagtgcctatgcatacagacttggaattagatttttctctcccatcaagctcgaagtatacgtataaaagaaagctaacgagccctataaatcaggaacaatctgttgacctacacattgagatagagagccaaggaatttctacaagtgtccatgctttaggccattggtttgatggtaggttaaacctaaagacatcatttcactgttacggtgcctgtacaaagtatgaatacccttggcatactgcaagatgtcactttgaaagagattttgagtatgagaatagttggggttgtaatccagctgactgccctggtattggtacaggttgtacagcatgtggcatctatatcgaccagttgaagcctgtgggcagtgcatacaagctgattacagtccgttatagccgcaaagtctgtgtccagtttggagaggaaaacttatgtaaaactattgacatgaatgactgttttgtcacaaggcatgtgaaagtctgtattattgggacagtctcaaaattctctcaaggggacacactggtatttttaggtcctatggagggtggagggctaatatttaaagactggtgtacaagcacatgtcagtttggagatccaggagacattatgagtcccaaggataagggatttagttgtccagaattcactggtcacttccgcaaaaagtgcaactttgcaacgacacctgtatgtgaatatgatgggaatatggtatctggatataagaaggtcatggcaactattgattcttttcaagcatttaacacaagttctatccattacacagatgagcggattgaatggaaagatccagatgggatgttgaaggaccatcttaatatattggttacaaaagatattgattttgaaaaccttggagacagtccgtgtaaggtgggacttcagactgtttccattgaaggtgcatggggttcaggggttgggttcactttaacatgccaggtttctttaactgaatgttctcgtttcttgacctcaatcaaagcttgtgacaaggcaatatgctatggcgcacagagtagcaccctcattcgaggacaaaatacagtaaaagtgtctgggaagggaggacatagtggttcatcctttaagtgttgccatggaactgattgctcacagcaaggattgcaagctagtgcaccccatcttgacaagattaatggtattgtagaacaagaaaatgaaaaagtttatgacgatggtgcaccacagtgtggtatttcatgctggtttgtgaagtctggagaatggattcaaggtatcttcaatgggaattggattgtaattgttgtcctaatctttttcttcatcctatcattgatattgctcagcatcttttgtccaattcgaaagcataaacgctcctag

SEQ ID NO: 3278 - RNA, 3408 nt, synthetic construct
  misc_feature 1..3408: note = derived and/or modified CDS sequence (wt) from DOBV(GER/05/477/Af)__GQ205411.1__GP
  source 1..3408: mol_type = other RNA
atgatcatgtggggtttactattgacactgagtttgatcaatctcggggcatccctgaggaatgtgtatgacatgaagatagaatgtccgcactcaatcaattttggagagagtagtgtgacaggtaaagttgaactaccccccctcctgctaactgatgcagaggctctagttcctgaaagctcttgtaatatggacaaccaccaatccctatcgatcacacagaaagtgacaaaggttagctggagaaaaaaggcagacaaagtccaagcggctaaggattcatttgaaacaacatcaagtgaagtaaattttaaaggaacatgcacattgacccataggatggttgaagaatcttacagaaatagaaaatcagtcatatgttatgatctttcctgcaattcaacacactgcaagccaacaatgcatatgattgttcctgtccattcatgtaatatgatgaaaagctgccttgtagggctagggccttaccgaatccaagttgtttatgagagaacatactgcacaactggtatattgacagaagggaaatgctttgtaccagaccagagtattatcagtgtgctaaaaaatggggtttttgacattgcaagtgtgagcattgtttgtttctttatccggataaaagggactagctataaaataatgacaagtataaaggaggcaaacccaaataactgcaatgacactgacaataaagttcagggctactacctatgcattgtaggagccaactcctctcctgtttatgcaccctcaaccactgattttagatcagtggaggcactcgctagtctattaagatctccccatggtgaagaccatgatttggcaggagaagaggttgcaacttattcaattgctggccaagttgagggtaaagtcccacacactgcaaatgcagcaaatatgctattcactgcattttcaggaattcctagttattcttcatttagtgtcttcaccggaaaccaggaagggaatgtaatttatagccctggattgttcccaaaattaaaccaatcatcatgtgagaaggttgcattaccattaatatgggagggatatatagacttacctggttattatgaaacagtccatccttgtaatgtcttttgtgtattgtctggcccaggagcatcatgtgaggcattttcagaaggtggtatcttcaacatcacatccccgacatgcttggtttcaaaacagaacaggttcagggctgcagagcagcagattaattttgtatgtcaacgagttgatcaggacattgtgatatactgtaatgggcagaagaaaaccatcttaacaaagacattggtaattggacagtgtatctattcagtaactagtctattttcaattatgccaggtgtggctcactctattgcaattgaattatgtgtacctgggtttcatggctgggccactgctgccctattaactacattctgctttggctggatattaataccatctatcacactggctattttgattattctaaaattctttgctgcactctttcataatagctcccaagagaaccgatttaaaataattttgaagaaaattaaggaggaatttgagaaaactaagggatcaatggtttgtgaagtgtgcaagtatgaatgtgaaacagggaaagaacttaaagcacataatttatcctgcccacaatcacaatgtccttactgcttcacacactgtgagctcacagaatcagcatttcaggcacactatcgagtttgtcaggccacacatagatttagagatgacttgaagaaaacaataacacctcagtcgacaagtcctggttgttatcgtacattaaatcttttcagatacaaaagcaggtgttacatttttactgtatgggtaattctcctcatcattgagtctattttgtgggctgctagtgcatcagaaactgtcttagaaccaagttggaatgacaatgcacatggtgtcggtgtggttccgatgcacactgatttggaattggacttttctcttccttcaagttccaaatatacatataagagaaagttaacaagtcctataaatcaagaacaatcagtagaccttcacattgagattgaaagccaaggaatttccacaagtgtgcatgcattaggccactggtttgatggaaggttaaacctaaaaacatcttttcattgttacggtgcatgcaccaaatatgagtatccttggcatacagcaaaatgtcacttcgaaagagattttgagtatgagaatagttggagttgtaaccctgcagactgtccagggattggcactggctgtactgcatgtgggttatatcttgaccaacttaagccagttggaagtgcttacaaattgattacagtccgttatagtcggaaagtgtgtgttcaatttggtgaagaaaacctttgtaaaactatcgacatgaatgattgctttgtgaccaggcatgtgaaggtatgcattataggcacagtctcaaaattttcacagggtgacaccctagtattccttggtcccatggagggcggaggtctaatatttaaagactggtgcacaacaacatgtcagtttggggatccaggggatatcatgagtcctaaagataagggtttcagctgtcctgactttacaggtcatttcaggaaaaaatgtaactttgccactacacctgtatgtgaatatgatggcaacatggtctcaggatacaagaaagtgatggcaactattgattcttttcaagcatttaatactagtaacatacattacactgatgagcggattgaatggaaagatccagatgggatgcttaaagatcatttgaacatacttgtcacaaaagacatcgattttgaaaatcttggtgaaaacccttgcaaggttgggttacaaacagcttcaatagacggtgcctggggttctggggttgggttcactcttacttgtcagatttcgctaactgaatgttcgcgctttttgacatcaattaaggcatgtgacatggccatttgctatggtgcacaaagtgtcacacttgttagagggcaaaatactgtgagggtttctgggaagggtgggcatagtggctcttccttcaaatgctgtcatggcactgactgttcgcagcaagggcttcaagcaagtgctccacacttagacaaggtcaatggcattgttgaacaagaaagtacacaggtgtatgatgatggcgcacctcaatgtggtatttcatgctggtttgtaaagtctggggagtggataaagggtatcttcaatgggaattggattgtcattgttgtgttaatctttcttttcttactttctttgatattacttagttttttatgccctattcgcaagcataagcgctcatag

SEQ ID NO: 3279 - RNA, 3408 nt, synthetic construct
  misc_feature 1..3408: note = derived and/or modified CDS sequence (wt) from DOBV(GER/07/607/Af)__GQ205410.1__GP
  source 1..3408: mol_type = other RNA
atgatcatgtggggtttattagtgacactgagtttgatcaatcttggagcatccctgaggaatgtgtatgacatgaaaatagaatgtccacactcaatcaattttggagagagcagtgtaacaggtaaagttgaattacccccccttccactcactgatgcagagactttggttccggagagctcttgtaatatggataaccaccaatctctatcaattacacagaaagtaacaaaagttagttggagaaaaaaggcagacaaagtccaagcagctaaggattcatttgaaaccacatcaagtgaaatgaatcttaaagggacatgcacattgactcacaggatggttgaagaatcatacagaaatagaaaatcagtcatttgctatgacctttcttgtaattcaacacactgtaagccaactatgcatatgattgttcctgtccattcatgtaatatgatgaagagttgtcttgtggggctggggccttacaggatccaagttgtttatgaaagaacatattgcacaactggcatattgacagagggaaaatgctttgtaccagaccaaagtattatcagtgttatgaaaaatggggtttttgatattgcaagtgtaagtattgtctgtttcttcattcggataaagggaactagctataaaataatgacaagcataaaggaagcaaaccccaataattgcaatgacactgacactaaagttcagggctactacctgtgcattgtaggagctaactcctcccctgtttatgcaccctcaaccaccgattttaggtcagtggaggcactagctagtctattaaggtctccccacggtgaggaccatgatttggcaggagaagaggttgcaacttattcaattgctggtcaggttgagggcaaagtcccacacactgcaaatgcagcaaatatgctatttactgcattttcaggaattcctagctactcctcatttagtgtttttactgggaaccaagatggaaccgtgatttatagccctggactattcccaaaattaaaccaatcctcgtgtgacaaggttgcattgcccttgatatgggagggatacatagacttacctggatattatgaaacagtccacccttgtaatgtcttttgtgtgttgtctggcccaggagcatcatgtgaggcattttcagaaggtggtatcttcaacataacatccccaacctgtctggtttcaaaacagaacaggttcagggctgcagagcagcaaatcaactttgtatgtcagcgggttgatcaagacattgtaatatactgtaatgggcagaagaaaaccatcttaacaaagacactggtaattggacagtgtatttattcagtaacaagcctgttttcaataatgccaggtgtagcacactctattgcaattgaattatgtgtgcctggatttcatggttgggccactgctgctctcctaactaccttctgttttggttggatattaataccatctattacactggctattttgattgttctaaaattctttgctgcactattgcataatagctcccaagaaaatcgatttaagataattctgaagaagatcaaggaagaatttgaaaaaactaaagggtcgatggtttgtgaggtgtgtaaatatgaatgtgaaacagggaaagaactcaaagcacataatttatcctgcccacaatcacagtgtccttactgctttacacactgtgagctcacagaatctgcatttcaagcacactatcgagtctgtcaggccacacatagatttagggatgatttgaagaaaacaataacacctcagtcaacaagccctggctgttatcgtacattaaatcttttcagatacaaaagtaggtgctatattttcacagtgtgggtaattctcctcatcattgagtctattttatgggctgcaagtgcatcagaaactgtcttagaaccaagttggaatgacaatgcacatggtgttggtgtggtcccaatgcacgctgatttggagttagatttttctcttccatcaagttctaaatacacatataaaaggaaattaacaagtcctattaatcaagaacaatcagtagaccttcatattgagatagagagccaaggaatttctacaagtgtacatgctttaggccactggtttgatgggagattaaacttaaaaacatctttccattgctatggtgcatgtaccaaatatgagtatccttggcatacagcaaaatgtcactttgagagagattttgagtatgagaatagctggagttgtaaccctgcagactgtccaggcatcggtactggttgcactgcatgtgggttatatcttgaccaacttaaacctgttggaagtgcttataaattaatcacagtccgttatagtcggaaagtgtgtgtccaatttggtgaagaaaacctttgtaaaactattgacatgaatgattgctttgtgaccaggcatgtgaaggtatgcatcataggcacagtttcaaaattttcacagggtgataccctagtatttcttggtcccatggagggtggaggtttaatattcaaggactggtgcacaacaacatgtcagttcggggatcctggggacatcatgagccctaaggataagggtttcagctgtcctgactttacgggtcatttcagaaaaaaatgcaactttgctaccacacctgtatgtgaatatgacggtaacatggtctctggatacaagaaagtgatggcaactattgattcttttcaagcatttaatactagtaacatacattatactgatgagcggattgaatggaaagatccagatgggatgcttaaagaccatttaaacatacttgtcacaaaagacattgattttgaaaatcttggtgaaaacccttgcaaagttgggctacagacagcttctatagatggtgcctggggttctggggttgggttcactcttacttgtcagatttcactgactgaatgttcacgctttttaacatcaattaaggcatgtgatatggccatttgctacggtgcacagagtgttacactcgttagagggcaaaatactgtgaaggtttctgggaagggtgggcatagtggctcctccttcaagtgctgtcatggtactgactgttcgcagcaagggcttcaagcaagtgctccgcacctagacaaggttaatggcattgttgaacaggagagtacacaggtatatgatgatggtgcacctcaatgtggcatttcatgctggtttgtgaagtctggggagtggataaaaggtatcttcagtggaaattggattgtcattgttgtgttaatcttcttgttcttactttctttgatattacttagttttttgtgccctattcgcaagcataagcgctcatag

SEQ ID NO: 3280 - RNA, 3408 nt, synthetic construct
  misc_feature 1..3408: note = derived and/or modified CDS sequence (wt) from DOBV(GER/08/118/Aa)__GQ205412.1__GP
  source 1..3408: mol_type = other RNA
atgatcatgtggggtttattagtgatactgagtttgatcaatcttggagcatccctgaggaatgtgtatgacatgaaaatagaatgtccacactcaatcaattttggagagagtagtgtaacaggtaaagttgaattacctccccttccactcactgatgcagagactttggttcctgagagctcttgtaatatggataaccaccaatccctgtcaattacacagaaagtaacaaaagttagttggagaaaaaaggcagacaaagtccaagcagctaaggattcatttgaaaccacatcaagtgaaataaatcttaaggggacatgcacattgactcacaggatggttgaagaatcatacagaaatagaaaatcagtcatatgctacgacctttcttgtaattcaacgcactgtaagccaactatgcacatgattgttcctgtccattcatgtaatatgatgaagagttgtcttgtggggctggggccttacaggatccaagttgtttatgaaagaacatattgcacaactggcatattgacagagggaaaatgctttgtaccagaccaaagtattatcagtgttatgaaaaatggggtctttgatattgcaagtgtaagtattgtctgtttctttattcgaataaagggaactagctataaaataatgacaagcataaaggaagcaaacccaaataactgcaatgacactgacaataaagttcagggctactacctatgtattgtaggagctaactcctctcctgtttatgcaccctcaaccaccgattttaggtcagtggaagcactagctagtctattaaggtctccccatggtgaggaccatgatttggcaggagaagaggttgcaacttattcaattgctggtcaggttgacggaaaagtcccacacactgcaaatgcagcaaatatgctattcactgcattttcaggaatccctagctactcctcatttagtgtttttactgggaaccaagatggaaccgtgatttatagccctggactattcccaaaattaaaccaatcctcgtgtgacaaggttgcattgcccttaatatgggaaggatacatagacttacctggatactatgaaacagtccacccttgtaatgtcttttgtgtgttgtctggcccaggagcatcatgtgaggcattttcagaaggtggtatcttcaacataacatccccaacctgtctggtttcaaaacagaacaggttcagggctgcagagcagcaaattaattttgtatgtcagcgggttgatcaagacattgtaatatactgtaatgggcagaagaaaaccattttaacaaagacactggtaattggacagtgtatctattcagtaacaagtctgttttcaataatgccaggtgtagcacactctattgcaattgaattatgtgtgcctgggtttcatggttgggccactgctgctctcctaactactttctgctttggctggatattaataccatctattacactggctattttgattgttctaaaattctttgctgcactattgcataatagctcccaagaaaacagatttaaaataattttgaagaagatcaaggaggaatttgaaaaaactaaagggtcgatggtttgtgaggtgtgtaaatatgaatgtgaaacagggaaagaactcaaagcacataatttatcctgcccacaatcacagtgtccttactgctttacacactgtgagctcacagaatctgcatttcaagcacactatcgagtctgtcaggccacacatagatttagggatgatttgaagaaaacaataacacctcagtcaacaagccctggctgttatcgtacattaaatcttttcagatacaaaagtaggtgttatattttcacagtttgggtaatcctcctcatcattgagtctattttatgggctgcaagtgcatcagaaactatcttagaaccaagttggaatgacaatgcacatggtgttggtgtggtcccaatgcatactgatttggagttggatttttctcttccatcaagttctaaatacacatataaaaggaagttaacaagtcctattaatcaagaacaatcagtagaccttcatattgagatagagagccaaggaatttctacaagtgtacatgctttaggccactggtttgatgggagattgaacttaaaaacatctttccattgctatggtgcatgtaccaaatatgagtatccttggcatacagcaaaatgtcactttgagagagattttgagtatgagaatagttggagttgcaaccctgcagactgtccaggcattggtactggttgcactgcatgtgggttataccttgaccaactcaaacctgttggaagtgcttataaattaatcacagtccgttatagccggaaagtgtgtgtccaatttggtgaagaaaacctttgtaaaactattgacatgaatgattgctttgtgaccaggcatgtgaaggtatgcattataggcacagtttcaaaattttcacagggtgataccctagtatttcttggtcccatggagggtggaggtttaatattcaaagactggtgcacaacaacatgtcagttcggggatcctggggacatcatgagccctaaggataagggtttcagctgtcctgactttacgggtcatttcagaaaaaaatgcaactttgctaccacacctgtatgtgaatatgacggtaacatggtctctggatacaagaaagtgatggcaactattgattcttttcaagcatttaatactagtaacatacattatactgatgagcggattgaatgggaagatccagatgggatgcttaaagaccatttaaacatacttgtcacaaaagacattgattttgaaaatcttggtgaaaacccttgcaaagttgggttacagacagcttctatagatggtgcctggggttctggggttgggttcactcttacttgtcagatttcactgactgaatgttcacgctttttaacatcaattaaggcatgtgatatggccatttgctacggtgcacagagtgttacactcgttagagggcaaaatactgtgaaggtttctgggaagggtgggcatagtggctcctcctttaagtgctgtcatggtactgactgttcgcagcaagggcttcaagcaagtgctccgcacttagacaaggttaatggcattgttgaacaggagagtacacaggtatatgatgatggcgcacctcaatgtggcatttcatgctggtttgtgaagtctggggaatggataaaaggtgtcttcagtggaaattggattgtcattgttgtgttgatcttcttgttcttactttccttgatattacttagttttttgtgccctattcgcaagcataagcgctcatag

SEQ ID NO: 3281 - RNA, 3408 nt, synthetic construct
  misc_feature 1..3408: note = derived and/or modified CDS sequence (wt) from DOBV(GER/08/131/Af)__GQ205413.1__GP
  source 1..3408: mol_type = other RNA
atgatcatgtggggtttactattgacactgagtttgatcaatctcggtgcatctctgaggaatgtgtatgacatgaaaatagaatgtccacactcaatcaattttggagagagcagtgtgacaggaaaagttgaattaccccccctcttgctcactgatgcagagactctggttcctgagagctcttgtaatatggataaccatcagtccctatcaattacacagaaagtgacaaaggttagctggagaaaaaaggcagacaaagtccaagctgcaaaggattcatttgaaaccacatcaagtgaagtgaatcttaaagggacatgcacattgactcacaggatggttgaagaatcttacagaagtagaaagtcagtcatatgctatgacctttcttgtaattcaacacactgtaagccgactatgcacatgattgttcctgtccattcatgtaatatgatgaaaagctgccttgtggggctagggccttaccggatccaagttgtttatgaaagaacatactgcacaactggcatattgacagaagggaaatgctttgtaccagaccaaagtattatcagtgtaataaaaaatggggtttttgatattgcaagtgtaagcattgtctgtttctttatccggataaagggaactagctataaaataatgacaagcataaaggaatcaaatccaaataactgcaatgacaccgacaataaagttcagggctattacttgtgcattgtaggagctaactcctctcctgtttatgcaccctcaactactgattttaggtcagtggaggcacttgctagtttattaagatctccttatggtgaggatcatgatttagcaggagaagaggttgcaacatattcaattgctggtcaggttgaaggcaaagtcccacacactgcaaatgcagcaaatatgctatttactgcattttcaggaattcctagctattcttcatttagtgtctttactgggaaccaggatggaaatgtgatttatagtcctgggctgttcccaaaattaaaccaatcatcatgcgaaaaggttgcattgcctttgatttgggagggatacatagacttacctggctattatgaaacagtccacccttgtaatgttttctgtgtgttgtctggtccaggagcatcatgtgaggcattttcagaaggtggtatcttcaacataacatctccaacctgtctggtttcaaaacagaacaggttcagggctgcagagcagcaaattaattttgtgtgtcaacgggttgatcaagacattgtaatatactgtaatgggcagaagaaaaccatcttaacaaagacattggtaattggacaatgcatctattcagtgacaagtctgttttcaataatgccaggtgtagcccactctatagcaattgaattatgtgtgcctggttttcatggctgggccactgctgccctcctaactacattctgctttgggtggatattgataccgtctattacactggctatattgattgtcttaaagttctttgctgcattattgcataatagctctcaagaaaatcgatttaaaataattttgaagaagattaaggaggaatttgaaaaaactaaaggatcaatggtttgtgaggtatgtaagtatgaatgtgagacaggaaaagaactcaaagcacataacttatcctgcccacaatcacaatgtccttattgctttacacattgtgagctcacagaatctgcatttcaagcacactatcgagtttgccaggccacacatagatttagggatgacttgaagaagacaataacacctcagtcaacgagccctgggtgttatcgtacattgaatcttttcagatacaaaagtaggtgttatatctttacagtgtgggtgattctcctcatcattgagtctatcttatgggctgcaagtgcatcagaaattgtcttagaaccaagttggaatgacaatgcacatggtgttggtgtggtcccaatgcacactgatctggaactagatttttcccttccttccagttcgaaatacacatataagaggaagttaacaagtcctattaatcaagaacaatcagtagaccttcatattgagatagagagtcaaggaatttccacgagtgtgcatgctttaggccactggtttgatgggaggttaaatttaaaaacatctttccactgttatggtgcatgtaccaaatatgaatatccttggcatacagcaaaatgtcactttgagagagattttgagtatgagaacagttggagctgtaaccctgcagactgcccagggattggtactggttgcactgcatgtgggttatatcttgaccaacttaagccagttggaagtgcttataaactaattacagtccgttatagtcggaaagtttgtgtccaatttggtgaagaaaacctttgtaaaactattgacatgaatgattgctttgtgactagacatgtgaaggtttgcatcataggcacagtttcaaaattttcacagggtgataccctagtgtttcttggtcccatggagggtggaggtttaatattcaaagactggtgtacaacaacgtgtcagttcggggatccaggggacatcatgagtcctaaggataagggtttcagctgtcctgacttcacaggtcattttagaaaaaaatgcaattttgctaccacacctgtatgtgaatatgatggcaacatggtttctggctacaagaaagtgatggcaactattgattcttttcaagcatttaatactagtaacatacattatactgatgagcggatcgaatggaaagatacggatgggatgcttaaagaccatttgaacatacttgttacaaaagacattgattttgaaaatctgggtgagaacccctgtaaagttgggctacagacagcttctatagatggtgcctggggttctggggttggttttactcttacttgccagatctcactgactgaatgttcacgcttcttgacatcaattaaggcatgtgatatggctatttgctatggtgcacaaagtgttacacttgttagagggcaaaataccgtgagggtttccggaaagggtgggcacagtggctcttcctttaagtgctgtcatggcactgattgttcacaccaagggcttcaagcaagtgctccacacttagacaaggttaatggcattgttgaacaagagagtacacaggtatatgatgatggtgcacctcaatgtggcatttcatgctggtttgtaaagtctggagagtggataaaaggtatcttcagtggaaattggattgtcattgttgtattaatcttccttttcttactttctttgatattacttagttttctgtgccctattcgcaagcataagcgctcatag

SEQ ID NO: 3282 - RNA, 3408 nt, synthetic construct
  misc_feature 1..3408: note = derived and/or modified CDS sequence (wt) from DOBV(GRW/Aa)__JQ026205.1__GP
  source 1..3408: mol_type = other RNA
atgatcatgtggggtttactattgacactgagtttgatcaatctcggtgcatctctgaggaatgtgtatgacatgaaaatagaatgtccacactcaatcaattttggagagagcagtgtaacaggtaagggcgaattaccccccctcttgctcactgatgcagagactctggttcctgagagctcttgtaatatggataaccatcagtccctatcaattacacagaaagtgacaaaggttagctggagaaaaaaggcagacaaagtccaagctgcaaaggattcatttgaaaccacatcaagtgaagtgaatcttaaagggacatgcacattgactcacaggatggttgaagaatcttacagaagtagaaagtcagtcatatgctatgacctttcttgtaattcaacacactgtaagccgactatgcacatgattgttcctgtccattcatgtaatatgatgaaaagctgccttgtggggctagggccttaccggatccaagttgtttatgaaagaacatactgcacaactggcatattgacagaagggaaatgctttgtaccagaccaaagtattatcagtgtaataaaaaatggggtttttgatattgcaagtgtaagcattgtctgtttctttatccggataaagggaactagctataaaataatgacaagcataaaggaatcaaatccaaataactgcaatgacaccgacaataaagttcagggctattacttgtgcattgtaggagctaactcctctcctgtttatgcaccctcaactactgattttaggtcagtggaggcacttgctagtttattaagatctccttatggtgaggatcatgatttagcaggagaagaggttgcaacatattcaattgctggtcaggttgaaggcaaagtcccacacactgcaaatgcagcaaatatgctattcactgcattttcaggaattcctagctattcttcatttagtgtctttactgggaaccaggatggaaatgtgatttatagtcctgggctgttcccaaaattaaaccaatcatcatgcgaaaaggttgcattgcctttgatttgggagggatacatagacttacctggctattatgaaacagtccacccttgtaatgttttctgtgtgtcgtctggtccaggagcatcatgtgaggcattttcagaaggtggtatcttcaacataacatctccaacctgtctggtttcaaaacagaacaggttcagggctgcagagcagcaaattaattttgtgtgtcaacgggttgatcaagacattgtaatatactgtaatgggcagaagaaaaccatcttaacaaagacattggtaattggacaatgcatctattcagtgacaagtctgttttcaataatgccaggtgtagcccactctatagcaattgaattatgtgtgcctggttttcatggctgggccactgctgccctcctaactacattctgctttgggtggatattgataccgtctattacactggctatattgattgtcttaaagttctttgctgcattattgcataatagctctcaagaaaatcgatttaaaataattttgaagaagattaaggaggaatttgaaaaaactaaaggatcaatggtttgtgaggtatgtaagtatgaatgtgagacaggaaaagaactcaaagcacataacttatcctgcccacaatcacaatgtccttattgctttacacattgtgagctcacagaatctgcatttcaagcacactatcgagtttgccaggccacacatagatttagggatgacttgaagaagacaataacacctcagtcaacgagccctgggtgttatcgtacattgaatcttttcagatacaaaagtaggtgttatatctttacagtgtgggtgattctcctcatcattgagtctatcttatgggctgcaagtgcatcagaaattgtcttagaaccaagttggaatgacaatgcacatggtgttggtgtggtcccaatgcacactgatctggaactagatttttcccttccttccagttcgaaatacacatataagaggaagttaacaagtcctattaatcaagaacaatcagtagaccttcatattgagatagagagtcaaggaatttccacgagtgtgcatgctttaggccactggtttgatgggaggttaaatttaaaaacatctttccactgttatggtgcatgtaccaaatatgaatatccttggcatacagcaaaatgtcactttgagagagattttgagtatgagaacagttggagctgtaaccctgcagactgcccagggattggtactggttgcactgcatgtgggttatatcttgaccaacttaagccagttggaagtgcttataaactaattacagtccgttatagtcggaaagtttgtgtccaatttggtgaagaaaacctttgtaaaactattgacatgaatgattgctttgtgactagacatgtgaaggtttgcatcataggcacagtttcaaaattttcacagggtgataccctagtgtttcttggtcccatggagggtggaggtttaatattcaaagactggtgtacaacaacgtgtcagttcggggatccaggggacatcatgagtcctaaggataagggtttcagctgtcctgacttcacaggtcattttagaaaaaaatgcaattttgctaccacacctgtatgtgaatatgatggcaacatggtttctggctacaagaaagtgatggcaactattgattcttttcaagcatttaatactagtaacatacattatactgatgagcggatcgaatggaaagatccagatgggatgcttaaagaccatttgaacatacttgttacaaaagacattgattttgaaaatctgggtgaaaacccctgtaaagttgggctacagacagcttctatagatggtgcctggggttctggggttggttttactcttacttgccagatctcactgactgaatgttcacgcttcttgacatcaattaaggcatgtgatatggctatttgctatggtgcacaaagtgttacacttgttagagggcaaaataccgtgagggtttccggaaagggtgggcacagtggctcttcctttaagtgctgtcatggcactgattgttcacaccaagggcttcaagcaagtgctccacacttagacaaggttaatggcattgttgaacaagagagtacacaggtatatgatgatggtgcacctcaatgtggcatttcatgctggtttataaaatctggagagtggataaaaggtatcttcagtggaaattggattgtcattgttgtattaatcttccttttcttactttctttgatattacttagttttctgtgccctattcgcaagcataagcgctcatag

SEQ ID NO: 3283 - RNA, 3408 nt, synthetic construct
  misc_feature 1..3408: note = derived and/or modified CDS sequence (wt) from DOBV(Slo/Af-BER)__GU904035.1__GP
  source 1..3408: mol_type = other RNA
atgatcatgtggggtctactattgacaatgattttgatcgattttggggcatccttaaggaatgtttatgacatgaagatagaatgcccacattcaatcaactttggggagagcagtgtaacaggtaaggtggaattaccaccccttctgctcacagatgcagaggccttggtcccggagagttcttgtaacatggacaaccatcagtctatgtcaattatacaaaaagtgacaaaagtgagttggagaaaaaaggcagacaaagcccaagctgccaaggactcatttgagacaacatcaagcgaggttaatctgaaggggacatgcacattgagtcataggatggttgaagaatcctacaggaataggagatcagtgatatgctatgacttgtcttgcaattcaacacattgtaagccaacgatgcatatgattgtgcctgtgcactcatgcaacatgatgaaaagctgtctggttgggcttgggccttatcgaatccaagttgtctatgaaagaacctactgtacaactggtatactaacagaagggaagtgttttgtgccagaccagagtattgtcagtgtcatcaagaatggggtttttgacattgcaagtgtgagcattgtctgtttttttatcagagttaaaggaactaactacaagataatggcgagtattaaaacagcaactgcaaataactgtaatgacactgacaataaggttcaaggatattacctttgtattgttgggggaaattcttctcctgtgtatgcaccttcaaccactgattttagatctatggaagcacttgctagccttttaagagctcctcatggtgaggaccatgatttatctggagaagaggttgcaacttattcaattgccgggcaaattgaaggcaaaatcccacatactgcaaatgcagcaaacatgctatttactgcattctcaggaattcctagttactcttcattgagtgtttttattggaagtcaagatgggcctattatttatagcccaggattgtttcccaagttgaaccaatcttcatgtgataaggtcgcactaccattgatatgggaagggtacatagatctacctggctattatgaaacagttcacccgtgtaatgtcttttgtgtgctatctggcccaggagcatcatgtgaggcattctcagaaggtggtattttcaatattacatcccctacatgccttgtgtcaaagcaaaatcggttcagggcagctgagcagcaagtcaatttcgtatgccagcgagtcgaccaagacattattatctactgtaatggacaaaagaagacaattttgaccaagacattagtgattgggcagtgtatttattcagtgactagtttgttttcaataatgcctggggtagcacattcaattgcaatcgaattatgtgtaccagggttccatggctgggcaactgctgctcttctcaccacattctgctttggctggatactgatcccttccatcacattggctgtattggttgtcttaaagttttttgcagcaatcttacataatagctctcaagaaaaccgttttaaaattatcctaaggaagattaaagaagaatttgaaaagactaagggctcaatggtttgtgaagtgtgcaagtatgagtgtgaaacagggaaggagcttaaagcccataatttgtcttgccctcagtcacagtgtccttattgctttacacattgtgagcctacagaatctgccttccaggcacattataaagtgtgccaggcaacacacaggtttagagatgatttgaagaaaacaataacacctcaatctacaagcccgggttgttaccggacattaaatctctttaggtataaaagtaggtgttacatttttacagtgtgggtcaccctgctaatcattgaatcaatcatgtgggcagctagcgcatcagaaaatgttttggagccaagctggaatgacaacgcacatggtgttggtgttgtcccaatgcatactgatctggaactagatttttctcttccgtcaagttctaagtacacatataaaagaaaactgacaagtccattaaatcaagaacaatcagtagatcttcacatagagatagagagtcaagggatttctacaagtgttcatgcattaggtcattggtttgatgggagacttaatttaaagacatcttttcattgttatggtgcatgtactaagtatgaatatccttggcatacagcaaaatgccactttgaaagggatttcgagtatgagaacagctggggctgtaatcctgctgattgccctgggattggtacgggctgtactgcatgcggactatacattgaccaacttaaacctgtaggcagtgcatacaagctaatcacagtccgttacagccgtaaagtatgtgttcagtttggtgaagaaaacctatgtaagacaattgacatgaatgattgctttgttacaagacatgtcaaagtatgcattataggtacagtttcaaagttctcacaaggtgataccctagtattcctgggccctatggaaggtgggggcttaatatttaaggattggtgcactagcacatgccaatttggtgatcctggggacattatgagtcctaaagacaaagggtttagctgccctgacttcacaggccacttccggaaaaaatgcaactttgcaacaacacctgtatgcgagtatgatggtaatatggtctctgggtataagaaagtaatggcaactattgattcctttcagtcatttaacactagctcaattcattacacagatgaaaggattgaatggaaggaccctgatgggatgcttaaggaccatctcaatatacttgtcacaaaagacattgactttgaaaaccttggggagaacccgtgcaaagtagggcttcaaacatcatcaatagaaggtgcatggggctctggggttggtttcacccttacttgtcaaatctcactgacagaatgttcacgctttctgacatccattaaagcatgtgacatggcaatctgttatggtgcacaaagtgtcacactcattagaggccaaaatacagtgaaggtttccgggaagggtgggcatagtggctcttcattcaagtgttgtcatgggacagattgctctcagcaggggctacaagcaagcgcaccacacctagacaaagtcaatggaattgttgaacaagatagtgaaaaagtctatgatgatggtgcaccacaatgtggcatttcatgctggtttgttaagtctggggagtggataacaggaatctttaatggaaactggattgtcattgttgtgcttgtttttttcttcatactatccttaatcttacttagtcttttatgccccattcgtaagcataagcgctcataa

SEQ ID NO: 3284 - RNA, 3408 nt, synthetic construct
  misc_feature 1..3408: note = derived and/or modified CDS sequence (wt) from HTNV(76-118/POR)__KT885048.1__GP
  source 1..3408: mol_type = other RNA
atggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 3285 - RNA, 3408 nt, synthetic construct
  misc_feature 1..3408: note = derived and/or modified CDS sequence (wt) from HTNV(76-118)__Y00386.1__GP
  source 1..3408: mol_type = other RNA
atggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagcttgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctctcccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacagtgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaatcaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccattatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaggtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 3286 - RNA, 3408 nt, synthetic construct
  misc_feature 1..3408: note = derived and/or modified CDS sequence (wt) from HTNV(A16)__AF288645.1__GP
  source 1..3408: mol_type = other RNA
atgggtttatggaagtggctaataatggccgttttggtgtggccatgttttgccctaaggaatgtatatgacatgaagattgaatgcccccatacagtcaattttggggaaaacagtgtggtcgggtatgtggagctaccgcctatgccaatcgctgacatcactcagatgatgccagagagctcttgcagcatggataaccaccaatctctaaacacaatcacaaagtacacccaagtgagttggagaaagaaggctgaccaagcacagtcaagccaaacctcctttgagacagtttcttccgaggtggactttaaaggaacctgtgtattaaagcacaagatgatagaggattcctatcgcagccgtagatcaataatctgttatgatctttcatgcaatagtacattctgtaagcctaccctttatctaattgtgcctgtgcatgcctgtaacatgatgaagagctgcctaatagcattaggcccctatagagttcaagttgtctatgagaggacatactgtatgtcaggggtccttctagaaggaaaatgctttgtaccagaccagagtgttgtgagcattataaaacatggcatatttgatattgcaagtgtccatattgtttgcttttttgttgcaatcaagggcagtacatataaaatccttgaacaagttaaaaaatcatttgaactaacatgcaatgatactgataataagattcaggggtattatatatgtcttgtgggagggaattcagcacccatatatgtgccaacccttgatgacttcaggtcaatggaggcttttgctgggatttttaagtccccacacggggaagatcacgaccttgcaggggaggaagtagcctcttattccattgtagggcctgccaatgcaaaagtaccccacagtgccagtgcagatacactgggtttagtcgccttttcaggaatcccatcctactcatccttcagtgtcctcacaggatctacagatgcccgtcatgtctttagcccaggtttctttccacaactaaaccagacaaggtgtgataaaactgccataccattaacctggacaggaatgattgacctacctggttattatgaagcagtacacccttgcactgtcttctgtgttttgtccggtcctggtgcgtcctgtgaagcattttcagaaggggggatctttaatataacttctcccatgtgtttagtctcaaagcaaaatcgctttaggtcatcaaagcaacaagtgaactttgtttgtcaaagagtagatatggatattgtggtctattgtaatgggcaaaagaaagtaatattaacaaaaactctagtaattggccaatgtatatatacaataaccagcttattttcattgcttcctggtgttgcacattctattgctgtagaactgtgtgttcctggcttccacggttgggctacagctgctttgcttgtaacattttgctttggctgggttttaatacctgcagtcacccttgtcatattaacaattttaaagtttattgcaaacatcttccatacaagcaatcaggaaaatcggctcaagtcagttttgaagaaaatcaaggaagaatttgagaagactaaaggctccatggtttgcgatgtgtgtaaatatgaatgtgagacatataaagagttgaaggcacatggagtatcatgtcctcaatctcaatgcccatactgcttcacccactgtgagcctacagaagcagcatttcaagcccactacaaagtatgccaagtcactcatagatttcgggatgatttaaagaaaacagtgaccccccaaaattttacaccaggctgttatcgtaccttgaatctgtttagatataaaagccgatgttacatcttcacaatgtgggtatttttgctgatcctggaatccattttatgggctgcaagtgcttctgaaacacccttaacccctatttggaatgataatgctcacggagtaggatctatcccgatgcacacagaccttgaattagatttttccctgacatctagctctaagtacacttatcgacggaagctcacaaacccacttgaggagactcaagcagtagatcttcatattgagttagctgaacagaccataggtgtagacgtgcatgctttggggcattggtttgacggccgcttaaatctaaagacctcctttcattgttatggtgcatgcacaaagtatgaatacccatggcataccgcaaaatgccattacgaaagagattatcagtatgaaacaagttggggctgtaacccatcagactgccctggagtaggtacaggctgtacagcatgtggattataccttgaccaactaaaacctgttggtagtgcatacaagattatcacaatcagatatagcaggagagtttgtgtccagtttggtgaagaaaacctttgtaaggttattgatatgaatgactgctttgtgtctagacatgtaaaagtgtgcataattggtacagtttctaagttttctcaaggtgatacactattgttctttggaccacttgagggtggtggtctaatattcaagcactggtgcacatctacatgccagtttggtgaccctggtgatataatgagtccgagagataaaggatttctatgtcctgaattcccaggcagctttaggaaaaagtgcaattttgctactacccctctctgtgagtatgatggaaatatgatctcaggttataagaaagtaatggcaacaattgattcttttcaatcattcaatacaagcaccatgcattttactgatgagcgaattgaatggaaagatcctgatggaatgttacgggatcatataaatattttagtaacaaaggatatagactttgataaccttggagaaaacccttgcaaaattggcttgcaaacatcctccattgaaggagcatggggctctggtgttggtttcacactcacatgtttagtatcattaacagaatgccctacttttctaacttcaattaaagcttgtgacaaagctatctgttatggtgcagagagtgttaccctaacaagagggcagaatacagttaaagtatcagggaagggtggacatagtggatcaacatttaagtgctgtcatggagaagattgttcacagactgggcttcatgctgctgcacctcaccttgataaagtcaatggaatctctgaaattgaaaatagcaaggtatatgatgatggggctccacagtgtgggataaaatgttggtttgtaaaatctggggagtggatttcaggaatctttagtggcaactggattgtgctcattgtactctgtgtattcctgctattctcattggtattgcttagtgtcctttgtcctgtaagaaagcataaaaaatcatag

SEQ ID NO: 3287 - RNA, 3408 nt, synthetic construct
  misc_feature 1..3408: note = derived and/or modified CDS sequence (wt) from HTNV(A9)__AF035831.1__GP
  source 1..3408: mol_type = other RNA
atggggatatggaagtggctagtgatggccagtttagtatggccagcttacacactgagaaatgcgtatgacatgaagattgaatgcccccatactgtaagttttggtgagaacagtgtgatagggtatgtggagttacctcctataccattagctgacacaacacaaatggtaccggaaagttcttgcagtatggacaaccaccagtcattgaatacaataacaaaatatacccaagtaagttggagaggtaaggctgatcacgcacaggccagccagaactcatttgaagcagtgtctgctgaagttgacctcaaaggaacttgtgttttaaagcataaaatgttagaagagtcataccgcagcagaaaatcaatagcttgttatgacctctcttgtaatagtacctattgcaagcctaccctgtatatgattgtgccaatccatgcatgcaatatgatgaaaagttgtttaattgcactaggaccccacagggtccaagtggtctatgaaagaacctactgcatgacaggggttctgatagaaggaaaatgttttgtcccagaccaaagtgttgtaagcattattaagcatggtatctttgacattgcaagtgtccacattgtttgcttctttgtggcagttaaaggaaacacttacaagatttttgagcagataaaaaagtcatttgagtccacatgcaatgatactaagaataaggtacagggatattacatctgcattgtagggggaaactctgcacctatatatgtgccaacacttgatgactttagatcaatggaagcattctcagggatctttagatcaccacatggggaggaccatgatttggctggagaagaaattgcttcatactctattgttggacctgccaatgcaaaagtacctcatagtgccagttcagacacattgagtctgactgcctattcaggtataccatcttattcctcacttagtatccttgcaggttcagcagaagctaagcatgtatttagtcctggattcttcccacagcttaatcatacaaaatgtgataagactgctataccattgatgtggacaggaatgattgacttgcctgggtattatgaggccatacatccttgtacagtcttctgtgttttatcaggcccaggggcatcatgtgaggcattttcagaaggtggcattttcaacataacatccccaatgtgtttagtctcaaaacagaaccgattccggctgacagaacagcaagtaaactttgtttgtcagagagttgatatggacattattgtgtattgtaatggtcagaggaaagtgatactaacaaaaaccttagttataggacagtgtatatataccataacaagtttgttctcactgttacctggggtagcacattctattgctgttgagttatgcgtccctgggtttcatgggtgggctacagctgctttgcttgttacattttgctttggctgggttctaataccagcaatgacatttattgtgctaacaattttgaaattcattgcaaatattttccatacaagtaaccaagagaataagcttaaatcagtactgaggaagataaaagaggaatttgaaaaaacaaaaggatcaatggtgtgtgatgtgtgtaaatatgagtgtgagacctacaaggagttgaaggcacatggggtttcatgtccccaatctcaatgcccatattgcttcactcattgtgaacctacagaagcagcattccaggctcattatagggtatgtcaagtcacccataggttcagagatgatttaaagaagactgtcactcctcaaaattttacacctggttgttatcggacgttaaaccttttcagatataaaagtagatgttacatttttacaatgtgggtcttcctcctggttttggagtccatactttgggccgctagtgcatcggaaatacccttaaaccctgtatggaatgacaacgcccatggagtaggttctgtaccgatgcccacagacttagagctggatttttctttaacatcaagttccaagtatacataccgtaggaaactaacaaatccgctagaagaatcacaggcaattaaccttcatattgaaatagaagaacagacaattggagttgatgtgcatgctttaggccattggtttgatggtcgtctcaatcttaagacatcctttcactgctatggtgcttgtacaaaatatgaatatccatggcatacagcaaagtgtcactatgagcgggattatcagtatgaaacaagttggggctgtaatccatctgactgccctggggtaggtacgggctgtacagcatgcggattgtaccttgaccaattaagggctgttggtagtgcatacaaaattattacaataagatacagcagaagagtatgtgtccaatttggggaagaaaatctatgtaagatcatagacatgaatgactgttttgtatccagacatgtcaaggtatgcataattggtacagtctctaaattttcccagggtgacacgctattattctttggacctctcgagggtggcggcttaatattcaaacactggtgtacatctacctgccaatttggggaccctggagatatcatgagtccaagggacaaaggatttttatgccctgaattcccaggtagttccaggaagaaatgcaacttcgctactacccctctctgtgaatatgatggaaatatggtatcagggtacaaaaaagtaatggcaacaattgattcctttcaatcctttaacactagtactatgcacttcactgatgagagaatagaatggaaagaccctgatggaatgttacgagaccacattaatattctagtaactaaggatattgactttgagaatcttggtggaaatccctgtaaaattggcttacagacatcctcaattgagggggcatggggctctggtgttggcttcaccctcacatgtttagtatcattgacagagtgccctacctttttaacatcaattaaggcttgcgataaagccatctgctatggtgcagaaagtgtaacattaacaagaggccagaatacagtcaaagtgtcagggaagggtggccatagtggctcaacttttaaatgctgtcatggggaagaatgttcacagattggactccatgctgctgcacctcaccttgataaggttaatgggatttctgaaattgagaataataaagtttatgatgatggtgcaccccagtgtgggataaagtgctggtttgtaaaatctggagaatggatttcagggattttcagtgggaactggattgtgctcattgtcctctgtgtgtttttattgttttcattgatattactcagtattctttgccctgtaagaaagcacaaaaagtcatag

SEQ ID NO: 3288 - RNA, 3408 nt, synthetic construct
  misc_feature 1..3408: note = derived and/or modified CDS sequence (wt) from HTNV(84FLi)__AF345636.2__GP
  source 1..3408: mol_type = other RNA
atgggggtatggaagtggctagtaatggccagtttagtctggccagcttgtacactgagaaatgtgtatgacatgaaaattgaatgcccccatacagtcagttttggtgagaatagtgtaattgggtatgtggaattaccccctatgccattagctgatacaacacagttggtgccagaaagctcttgcagtatggacaatcaccagtcattaaataccataacaaaatatacccaggtaagctggagaaagaaggctgatcaggcacagtccagccaaaattcatttgaaacagtatctgttgaggttgaccttaaagggacttgtgttttaaagcacaaaatgatagaagagtcataccgtagcagaaagtcaataacatgttatgacctttcctgcaacagtacctactgcaaacctaccctgtacatgattgtaccaatccatgcatgtaatatgatgaaaagctgtctaattgcactaggcccttacagagtgcaggtggtttatgaaagaacttattgcatgacaggggtcttaatagaaggaaaatgttttgttccagaccaaagtgttgtcagtattattaaacatgggatatttgacattgcaagtgttaaaattgtttgtttctttgtggcagttaagggaaacacttataaactgtttgagcaggttaaaaagtcatttgattctacatgcaatgacactgaaaacaaagtacagggatattacatctgtatcgttggaggaaattcagcacccatatatgtaccaacacttgatgatttcaggtcaatggaggcattctcagggatctttaggtcaccacatggagaagaccatgatctggctggagaagaggttgcttcatattcaattgttggacctgccaatgcaaaagttccacatagtgctagctctgacacgttaagtctaattgcctactcaggaataccatcttattcctcgctcagtatccttacaagctcaacagaggctaaacatgtttttagtcctggattctttccacaacttaatcatacaaagtgtgataaaactgctataccgctaacttggaccgggatgattgatttaccaggatattatgaagctatacacctttgtacagtattttgtgttttgtcaggtcctggggcatcatgtgaggcattttcagaaggtgggattttcaatataacatcccctatgtgcttagtgtcaaaacagaaccaattccggctaacaaagcagcaggtcaactttgtgtgtcaaagagtagacatggatattgttgtatactgtaatggccagagaaaagtgatactaactaagacaatggtcattgggcaatgtatatatactataacaagtttattttcactattacctggtgtagcacattcaattgctgttgaattatgtgttccaggcttccatgggtgggcaacagctgcactgcttgtcacattctgctttgggtgggttctcatacctgcagttacatttattatactaacagtcttaaaatttgttgcaaatatctttcacacaagtaaccaagagaacaggcttaaatcagtcctaagaaaaataaaggaagaatttgagaagacaaaaggatcaatggtgtgtgatgtctgtaaatatgagtgtgaaacttatagggaactgaaagcacatggggtttcatgtcctcagtcccaatgcccttactgcttcacccactgtgagcctacagaagctgcattccaggcccattacagagtatgtcaagtaacccacaggtttagggatgacctaaaaaagactgttacacctcaaaacttcacacctggctgttatcggacattaaacttatttaggtataagagtagatgttacatctttactatgtgggtttttctcttagttctggaatctatattgtgggctgcaagtgcatctgaggttcccttgaatcctatatggaatgataatgcacatggagtgggttctgtaccaatgcatacagatctggagcttgacttctcgttaacatcaagttctaaatacacataccgtagaaagctaacaaacccgcttgaggaaacacaagcaattgatcttcatattgaaatagaggaacagacaatcggtgttgatgtacatgctctagggcattggtttgatggtcgtctcaacctaaaaacatcatttcactgctatggggcatgcacaaagtatgaatacccatggcataccgcaaaatgccattacgaaagagattatcagtatgagacaagttggggctgtaacccatcagactgccctggagtaggtacaggctgtacagcatgtggattataccttgaccaactaaaacctgttggtagtgcatacaagattatcacaatcagatatagcaggagagtttgtgtccagtttggtgaagaaaacctttgtaaggttattgatatgaatgactgctttgtgtctagacatgtaaaagtgtgcataattggtacagtttctaagttttctcaaggtgatacactattgttctttggaccacttgagggtggtggtctaatattcaagcactggtgcacatctacatgccagtttggtgaccctggtgatataatgagtccgagagataaaggatttctatgtcctgaattcccaggcagctttaggaaaaagtgcaattttgctactacccctctctgtgagtatgatggaaatatgatctcaggttataagaaagtaatggcaacaattgattcttttcaatcattcaatacaagcaccatgcattttactgatgagcgaattgaatggaaagatcctgatggaatgttacgggatcatataaatattttagtaacaaaggatatagactttgataaccttggagaaaacccttgcaaaattggcttgcaaacatcctccattgaaggagcatggggctctggtgttggtttcacactcacatgtttagtatcattaacagaatgccctacttttctaacttcaattaaagcttgtgacaaagctatctgttatggtgcagagagtgttaccctaacaagagggcagaatacagttaaagtatcagggaagggtggacatagtggatcaacatttaagtgctgtcatggagaagattgttcacagactgggcttcatgctgctgcacctcaccttgataaagtcaatggaatctctgaaattgaaaatagcaaggtatatgatgatggggctccacagtgtgggataaaatgttggtttgtaacatctggagagtggatttcaggaatctttagtggcaactggattgtgctcattgtactctgtgtattcctgctattctcattggtattgcttagtgtcctttgtcctgtaagaaagcataaaaaatcatag

SEQ ID NO: 3289 - RNA, 3408 nt, synthetic construct
  misc_feature 1..3408: note = derived and/or modified CDS sequence (wt) from HTNV(Aa03-161)__KT934990.1__GP
  source 1..3408: mol_type = other RNA
atggggatatggaagtggctagtgatggccagtttagtatggcctgttttaacactgagaaatgtttatgacatgaaaattgagtgcccccatacagtaagcttcggggaaaatagtgtaataggctatgtggaactaccccccatgccattggctgacacagcacagctggtgcctgagagttcttgcagcatggataatcaccaatcattaaatacaataacaaaatatacccaagtaagttggagaggaaaggctgaccagtcacagtctagccaaaattcatttgagacagtgtctactgaagttgacttgaaaggaacatgtgttctgaaacacaagatggtagaagaatcttaccgcagtagaaaatcaataacctgttatgacctgtcatgcaatagcacttattgcaagccaacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaattctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacgaattgtgataaaggtgccataccactcatgtggactgggatgattgatttacctggatactatgaggctatccacccctgtacagtattttgtgtattatcaggtcctggggcatcatgtgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaggagtttgaaaaaacaaaaggctcaatggtatgtgatgtttgcaaatatgagtgtgaaacctataaagagttaaaggcacatggtgtgtcatgcccccagtctcaatgcccttattgctttactcattgtgaacccacagaagcagcattccaggcccattacaaagtatgccaagttactcacaggttcagggatgatctgaagaaaactgtcactcctcagaatttcacaccaggatgttaccgtacactgaatttatttagatacaaaagtaggtgctacatctttacaatgtggatatttcttcttgtcctagaatctatactatgggctgcaagtgcatcagagacaccactgactcctgtctggaatgacaatgcccatggagtaggttctgttcctatgcacacagatttagaacttgatttctctttaacatctagttccaagtatacataccgcaggaagctaacaaacccacttgaagaagcacaatccattgatttacatattgaaatagaagaacaaacaattggtgtggatgtacatgccctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagtcggtagtgcctataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgacacattattgtttttcggaccacttgaaggtggtggtctaatatttaaacactggtgcacttccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaggaaagtaatggcaacaattgattcctttcaatcttttaatacaagcactatgcactttactgatgaaaggatagagtggaaagaccctgatggaatgctgagggatcatataaacatcttagtaacaaaagacatcgactttgataacctcggtgaaaatccctgcaaaattggcctacaaacatcttccattgagggggcctggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcacagattggactccatgctgctgcacctcacctagacaaggtcaatgggatttctgagatggaaaatagcaaagtatatgatgatggagcaccgcaatgtgggataaaatgttggtttgtgaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3290 - RNA, 3408 nt, synthetic construct
  misc_feature 1..3408: note = derived and/or modified CDS sequence (wt) from HTNV(Aa03-386)__KT934991.1__GP
  source 1..3408: mol_type = other RNA
atggggatatggaagtggctagtgatggccagtttagtatggcctgttttaacactgagaaatgtttatgacatgaaaattgagtgcccccatacaataagcttcggggaaaatagtgtaataggctatgtggaactaccccccatgccattggctgacacagcacagctggtgcctgagagttcttgcagcatggataatcaccaatcattaaatacaataacaaaatatacccaagtaagttggagaggaaaggctgaccagtcacagtctagccaaaattcatttgagacagtgtctactgaagttgacttgaaaggaacatgtgttctgaaacacaagatggtagaagaatcttaccgcagtagaaaatcaataacctgttatgacctgtcatgcaatagcacttattgcaagccaacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaaaaaatcctttgaatcaacatgcaatgatacagagaataaagtgcaggggtattatatctgtattgtagggggaaattctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacaaattgtgataaaggtgccataccactcatgtggactgggatgattgatttacctggatactatgaggctatccacccctgtacagtattttgtgtattatcaggtcctggggcatcatgtgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactacctggagtagcacactctattgctgttgaattgtgtgtacctggattccatggttgggccacagctgctctacttgttacattctgttttggatgggttcttataccagcaatcacatttatcatactgacaatcctaaagttcattgctaatattttccacacaagtaaccaagagaacaggttaaaatcagtacttagaaagataaaggaggagtttgaaaaaacaaaaggctcaatggtatgtgatgtctgcaaatatgagtgtgaaacctataaagagttaaaggcacatggtgtgtcatgcccccagtctcaatgcccttattgctttactcattgtgaacccacagaagcagcattccaggcccattacaaagtatgccaagttactcacaggttcagggatgatctgaagaaaactgtcactcctcagaatttcacaccaggatgttaccgtacactgaatttatttagatacaaaagtaggtgctacatctttacaatgtggatatttcttcttgtcctagaatctatactatgggctgcaagtgcatcagagacaccactgactcctgtctggaatgacaatgcccatggagtaggttctgttcctatgcacacagatttagaacttgatttctctttaacatctagttccaagtatacataccgcagaaagctaacaaacccacttgaagaagcacagtccattgatctacatattgaaatagaagaacaaacaattggtgtggatgtacatgccctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaacccatcagattgtcctggggtgggcacaggctgtacagcatgtggtttatatctagaccgactgaaaccagtcggtagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattttctcagggtgacacattattgtttttcggaccacttgaaggtggtggtctaatatttaaacactggtgcacttccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataacctcggtgaaaatccctgcaaaattggcctacaaacatcttccattgagggggcctggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcacaaattggactccatgctgctgcacctcacctagacaaggtcaatgggatttctgagatggaaaatagcaaagtatatgatgatggagcaccgcaatgtgggataaaatgttggtttgtgaaatcaggggaatggatttcagggatattcagtggtaattggattgtactcattgttctctgcatatttctattgttctcattggttctactgagcattctctgtcctgtaaggaagcataaaaagtcatag

SEQ ID NO: 3291 - RNA, 3408 nt, synthetic construct
  misc_feature 1..3408: note = derived and/or modified CDS sequence (wt) from HTNV(Aa04-722)__KU207182.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattgaatacaataacaaagtatacccaagtaagttggagaggaaaggctgatcagtcacagtctagccaaaattcatttgagacagtgtctactgaagttgacttgaaaggaacatgtgttctgaaacacaagatggtagaagaatcataccgcagtagaaaatcaataacctgttatgacctatcatgcaatagcacttattgcaagccgacactatacatgattgtaccaattcatgcatgcaatatgatgaaaagctgtttgattgccttgggaccatacagagtacaagtagtttatgagagaacctattgcatgacaggagtcctaattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcatttgaatcaacatgcaatgatacagagaataaagtgcaggggtactatatctgtattgtggggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcctcccttagcatcctgacaagttcaacagaagccaaacatgtattcagccctgggttgttcccaaaacttaatcacacaaattgtgataaaggtgccataccactcatgtggactgggataattgatttacctggatactatgaggctatccatccctgtacagtattttgtgtattatcaggtcctggggcatcatgtgaggccttttctgaaggcgggattttcaacataacctcccctatgtgcttagtatcaaagcaaaatcgattccggttaacagaacagcaagtgaattttgtatgtcagcgagtggacgtggacattgttgtgtactgcaatgggcagagaaaagtaatattgacaaaaactttagttattggacaatgtatatacactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaaattcattgctaatattttccacacaagtaaccaagagaacaggttaaaatcagtacttagaaagataaaggaagagtttgaaaaaacaaaaggctcaatggtatgtgatgtctgcaagtatgagtgtgaaacctataaagagttaaaggcacatggtgtgtcatgcccccagtctcaatgcccttattgctttactcattgtgaacccacagaagcagcattccaggcccattacaaagtatgccaagttactcataggtttagggatgatctaaagaaaactgtcactcctcagaacttcacaccaggatgttaccggacactgaatttatttagatacaaaagtaggtgctacatctttacaatgtggatatttcttcttgtcctagaatctatactatgggctgcaagtgcatcagagacaccactgactcctgtctggaatgacaatgcccatggagtaggttctgttcctatgcacacagatttagaacttgatttctctttgacatctagttccaagtacacataccgtaggaagctaacaaaccctcttgaagaagcacaatccattgatctacatattgaaatagaagaacaaacaattggtgtggatgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctgtgtaagataatagacatgaatgattgttttgtatctaggcatgttaaggtctgtataattggtacagtatctaaattctctcagggtgatacattattgtttttcggaccacttgaaggtggtggtctaatatttaagcactggtgcacatccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggtctacaaacatcttccattgagggggcctggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcgcaaattggactccatgctgctgcacctcacctagacaaggtcaatgggatttctgagatggaaaatagcaaagtatatgatgatggagcaccgcaatgtgggataaaatgttggtttgttaaatcaggggaatggatttccgggatattcagtggtaattggattgtactcattgttctctgcgtatttctattgttctcattggttttactgagcattctctgtcccgtaaggaagcataaaaagtcatag

SEQ ID NO: 3292 - RNA, 3408 nt, synthetic construct
  misc_feature 1..3408: note = derived and/or modified CDS sequence (wt) from HTNV(Aa05-190)__KT934993.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattgactgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacacaagatgatagaagaatcttaccgcagtagaaaatcaataacctgttatgacttatcatgcaatagcacttattgcaagccaacactatacatgattgtaccaattcatgcatgcaatatgatgaaaagctgtttgattgcattaggaccatacagagtacaggtagtttatgagagaacctattgcatgacaggagtcctgattgaaggaaagtgttttgtcccagatcagagtgtggttagtattatcaagcatgggatctttgatattgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtattatcaggtcctggggcatcatgtgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctatcgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcgatggtatgtgatgtctgcaagtatgagtgtgaaacctataaagagttgaaggcacatggtgtgtcatgcccccagtctcaatgcccttattgctttactcactgtgaacctacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagacttagaacttgatttctctttaacgtctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatccacatgtcaatttggcgacccaggagacataatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctacaaacatcttccattgagggggcttggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggactgttcgcaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtgaggaagcataaaaagtcatag

SEQ ID NO: 3293 - RNA, 3408 nt, synthetic construct
  misc_feature 1..3408: note = derived and/or modified CDS sequence (wt) from HTNV(Aa09-1000)__KT935001.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaagtatacccaagtaagttggagaggaaaggctgatcagtcacagtctagccaaaattcatttgagacagtgtctactgaagttgacttgaaaggaacatgtgttctgaaacacaagatggtagaagaatcataccgcagtagaaaatcaataacctgttatgacctatcatgcaatagcacttattgcaagccgacactatacatgattgtaccaattcatgcatgcaatatgatgaaaagctgtttgattgccttgggaccatacagagtacaagtagtttatgagagaacctattgcatgacaggagtcctaattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcatttgaatcaacatgcaatgacacagagaataaagtgcaggggtactatatctgtattgtggggggaaactctgcaccaatatatgttccaacacttgatgatttcagatccatggaagcattcacaggaatctttagatcaccacatggagaagaccatgatctagctggagaagaaactgcaacttactctattgttggacctgccaatgcaaaagttcctcacagtgctagctcagatacattgagcctgattgccttctcaggtataccatcttattcctcccttagcatcctgacaagttcaacagaagccaaacatgtattcagccctgggttgttcccaaaacttaatcacacaaattgtgataaaggtgccataccactcatgtggactgggatgattgatttacctggatactatgaggctatccatccctgtacagtattttgtgtattatcaggtcctggggcatcatgtgaggccttttctgaaggcgggattttcaacataacctcccccatgtgcttagtatcaaagcaaaatcgattccggttaacagaacagcaagtgaattttgtatgtcagcgagtggacgtggacattgttgtgtactgcaatgggcagagaaaagtaatattgacaaaaactttagttattggacaatgtatatacactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaaattcattgctaatattttccacacaagtaaccaagagaacaggttaaaatcagtacttagaaagataaaggaagagtttgaaaaaacaaaaggctcaatggtatgtgatgtctgcaagtatgagtgtgaaacctataaagagttaaaggcacatggtgtgtcatgcccccagtctcaatgcccttattgctttactcattgtgaacccacagaagcagcattccaggcccattacaaagtatgccaagttactcataggtttagggatgatctaaagaaaactgtcactcctcagaacttcacaccaggatgttaccggacactgaatttatttagatacaaaagtaggtgctacatctttacaatgtggatatttcttcttgtcctagaatctatactatgggctgcaagtgcatcagagacaccactgactcctgtctggaatgacaatgcccatggagtaggttctgttcctatgcacacagatttagaacttgatttctctttgacatctagctccaagtacacataccgtaggaagctaacaaaccctcttgaagaagcacaatccattgatctacatattgaaatagaagaacaaacaattggtgtggatgtacatgctctaggacattggtttgatggtcgtcttaaccttaaaacatcctttcactgttatggtgcttgtacaaagtatgaatacccttggcatactgcaaagtgccactatgaaagggattaccaatatgagacaagttggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctgtgtaagataatagacatgaatgattgttttgtatctaggcatgttaaggtctgtataattggtacagtatctaaattctctcagggtgatacattattgtttttcggaccacttgaaggtggtggtctaatatttaagcactggtgcacatccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggtctacaaacatcttccattgagggggcctggggttctggtgtagggtttacattaacatgtctggtatcactaacagaatgtcctacctttttgacctctataaaggcttgtgataaggctatctgttacggtgcagagagtgtaacattaacaagaggacaaaatacagtcaaggtatcaggaaaaggtggccatagtggttcaacatttaagtgttgccatggggaggactgttcgcaaattggactccatgctgctgcacctcacctagacaaggtcaatgggatttctgagatggaaaatagcaaagtatatgatgatggagcaccgcaatgtgggataaaatgttggtttgttaaatcaggggaatggatctcagggatattcagtggtaattggattgtactcattgttctctgcgtatttctattgttctcattggttttactgagcattctctgtcccgtaaggaagcataaaaagtcatag

SEQ ID NO: 3294 - RNA, 3408 nt, synthetic construct
  misc_feature 1..3408: note = derived and/or modified CDS sequence (wt) from HTNV(Aa09-948)__KT935000.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaagtatacccaagtaagttggagaggaaaggctgatcagtcacagtctagccaaaattcatttgagacagtgtctactgaagttgacttgaaaggaacatgtgttctgaaacacaagatggtagaagaatcataccgcagtagaaaatcaataacctgttatgacctatcatgcaatagcacttattgcaagccgacactatacatgattgtaccaattcatgcatgcaatatgatgaaaagctgtttgattgccttgggaccatacagagtacaagtagtttatgagagaacctattgcatgacaggagtcctaattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcatttgaatcaacatgcaatgacacagagaataaagtgcaggggtactatatctgtattgtggggggaaactctgcaccaatatatgttccaacacttgatgatttcagatccatggaagcattcacaggaatctttagatcaccacatggagaagaccatgatctagctggagaagaaactgcaacttactctattgttggacctgccaatgcaaaagttcctcacagtgctagctcagatacattgagcctgattgccttctcaggtataccatcttattcctcccttagcatcctgacaagttcaacagaagccaaacatgtattcagccctgggttgttcccaaaacttaatcacacaaattgtgataaaggtgccataccactcatgtggactgggatgattgatttacctggatactatgaggctatccatccctgtacagtattttgtgtattatcaggtcctggggcatcatgtgaggccttttctgaaggcgggattttcaacataacctcccccatgtgcttaatatcaaagcaaaatcgattccggttaacagaacagcaagtgaattttgtatgtcagcgagtggacgtggacattgttgtgtactgcaatgggcagagaaaagtaatattgacaaaaactttagttattggacaatgtatatacactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaaattcattgctaatattttccacacaagtaaccaagagaacaggttaaaatcagtacttagaaagataaaggaagagtttgaaaaaacaaaaggctcaatggtatgtgatgtctgcaagtatgagtgtgaaacctataaagagttaaaggcacatggtgtgtcatgcccccagtctcaatgcccttattgctttactcattgtgaacccacagaagcagcattccaggcccattacaaagtatgccaagttactcataggtttagggatgatctaaagaaaactgtcactcctcagaacttcacaccaggatgttaccggacactgaatttatttagatacaaaagtaggtgctacatctttacaatgtggatatttcttcttgtcctagaatctatactatgggctgcaagtgcatcagagacaccactgactcctgtctggaatgacaatgcccatggagtaggttctgttcctatgcacacagatttagaacttgatttctctttgacatctagttccaagtacacataccgtaggaagctaacaaaccctcttgaagaagcacaatccattgatctacatattgaaatagaagaacaaacaattggtgtggatgtacatgctctaggacattggtttgatggtcgtcttaaccttaaaacatcctttcactgttatggtgcttgtacaaagtatgaatacccttggcatactgcaaagtgccactatgaaagggattaccaatatgagacaagttggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctgtgtaagataatagacatgaatgattgttttgtatctaggcatgttaaggtctgtataattggtacagtatctaaattctctcagggtgatacattattgtttttcggaccacttgaaggtggtggtctaatatttaagcactggtgcacatccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatctttcaatacaagcactatgcactttactgatgaaaggatagagtggaaagaccctgatggaatgctgagggatcatataaacatcttagtaacaaaagacatcgactttgataaccttggtgaaaatccttgcaaaattggtctacaaacatcttccattgagggggcctggggttctggtgtagggtttacattaacatgtctggtatcactaacagaatgtcctacctttttgacctctataaaggcttgtgataaggctatctgttacggtgcagagagtgtaacattaacaagaggacaaaatacagtcaaggtatcaggaaaaggtggccatagtggttcaacatttaagtgttgccatggggaggactgttcgcaaattggactccatgctgctgcacctcacctagacaaggtcaatgggatttctgagatggaaaatagcaaagtatatgatgatggagcaccgcaatgtgggataaaatgttggtttgttaaatcaggggaatggatctcagggatattcagtggtaattggattgtactcattgttctctgcgtatttctattgttctcattggttttactgagcattctctgtcccgtaaggaagcataaaaagtcatag

SEQ ID NO: 3295 - RNA, 3408 nt, synthetic construct
  misc_feature 1..3408: note = derived and/or modified CDS sequence (wt) from HTNV(Aa10-434)__KT935004.1__GP
  source 1..3408: mol_type = other RNA
atggggatatggaagtggctagtgatggccagtttagtatggcctgttttaacactgagaaatgtctatgacatgaaaattgagtgcccccacacagtaagcttcgggggaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaatttcatttgagacagtgtctactgaagttgacttgaaaggaacatgtgttctgaaacacaagatggtagaagaatcttaccgcagtagaaaatcaataacctgttatgacctatcatgcaatagtacttattgcaagccaacactatacatgattgtgccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggtcagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatttatgttccaacacttgatgatttcagatccatggaagcattcacaggaatcttcagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagtatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtgttatcaggtcctggggcatcatgtgaggccttttctgaaggcgggattttcaacataacctcccccatgtgcttagtgtcaaaacaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagaaaacaggttaaaatcagtacttagaaagataaaggaagagtttgaaaaaacaaaaggctcgatggtatgtgatgtctgcaagtatgagtgtgaaacctataaagagttgaaggcacatggtgtgtcatgcccccagtctcaatgcccttattgctttactcattgtgaacccacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaaatatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaagaaaacctttgtaagataatagacatgaatgactgttttgtatctaggcatgttaaggtctgtataattggtacaatatctaaattctctcagggtgatacattattgtttttcggaccacttgaaggtggcggtctaatatttaaacactggtgcacatccacatgtcaatttggcgacccaggagacattatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagtactatgcactttactgatgaaaggatagagtggaaagaccctgatgggatgctgagggatcatataaacatcttagtaacaaaagacatcgactttgataaccttggtgaaaatccttgcaaaattggcctacaggcatcttccattgagggggcctggggttctggcgtagggtttacattaacatgtctggtatcgctaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggactgttcacaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttttattgttctcattggttttactgagcattctctgccccgtgaggaagcataaaaagtcatag

SEQ ID NO: 3296 - RNA, 3408 nt, synthetic construct
  misc_feature 1..3408: note = derived and/or modified CDS sequence (wt) from HTNV(Aa10-518)__KT935005.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtccactgaagttgacttgaaaggaacatgtgttctgaaacacaagatggtagaagaatcttaccgcagtagaaaatcaataacctgttatgacctatcatgcaatagtacttattgcaagccaacactatacatgattgtgccaattcatgcatgcaatatgatgaaaagctgtttgattgcattgggaccatacagagtacaggtagtttatgagagaacctattgcatgacaggagtcctgattgaaggaaaatgttttgttccagatcagagtgtggtcagtattatcaagcatgggatctttgatatcgcaagtgttcatattgtgtgcttctttgtcgcagttaaagggaatacttataaaatttttgaacaggttaagaaatcctttgaatcaacatgcaatgatacaaagaataaagtgcaggggtattatatctgtattgtagggggaaactctgcaccaatttatgttccaacacttgatgatttcagatccatggaagcattcacaggaatcttcagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagtatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtgttatcaggtcctggggcatcatgtgaggccttttctgaaggcgggattttcaacataacctcccccatgtgcttagtgtcaaaacaaaatcgattccggttaacagaacagcaagtgaattttgtatgtcagcgagtggacgtggacattgttgtgtactgcaatgggcagagaaaagtaatattgacaaaaactttagttattggacaatgtatatacactataacaagcttattttcattactgcctggggtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagaaaacaggttaaaatcagtacttagaaagataaaggaagagtttgaaaaaacaaaaggctcgatggtatgtgatgtctgcaagtatgagtgtgaaacctataaagagttgaaggcacatggtgtgtcatgcccccagtctcaatgcccttattgctttactcattgtgaacccacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaaatatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtacagcaggagagtctgtgttcaattcggggaggaaaacctttgtaagatagtagacatgaatgactgttttgtatctaggcatgttaaggtctgtataattggtacagtatctaaattctctcagggtgatacattattgtttttcggaccacttgaaggtggcggtctaatatttaaacactggtgcacatccacatgtcaatttggcgacccaggagacattatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagtactatgcactttactgatgaaaggatagagtggaaagaccctgatgggatgctgagggatcatataaacatcttagtaacaaaagacatcgactttgataaccttggtgaaaatccttgcaaaattggcctacagacatcttccattgagggggcctggggttctggcgtagggtttacattaacatgtctggtatcgctaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggactgttcacaaattggactccatgctgctgcacctcacctagacaaggtcaatgggatttctgagatggaaaacagcaaagtatatgatgatggagcaccgcaatgtgggataaaatgttggtttgttaaatcaggggaatggatttcagggatattcagtggtaattggattgtactcattgttctctgcgtatttttattgttctcattggttttactgagcattctctgccccgtgaggaagcataaaaagtcatag

SEQ ID NO: 3297 - RNA, 3408 nt, synthetic construct
  misc_feature 1..3408: note = derived and/or modified CDS sequence (wt) from HTNV(Aa10-561)__KT935006.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaatttcatttgagacagtgtctactgaagttgacttgaaaggaacatgtgttctgaaacacaagatggtagaagaatcttaccgcagtagaaaatcaataacctgttatgacctatcatgcaatagtacttattgcaagccaacactatacatgattgtgccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggtcagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatttatgttccaacacttgatgatttcagatccatggaagcattcacaggaatcttcagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagtatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtgttatcaggtcctggggcatcatgtgaggccttttctgaaggcgggattttcaacataacctcccccatgtgcttagtgtcaaaacaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagaaaacaggttaaaatcagtacttagaaagataaaggaagagtttgaaaaaacaaaaggctcgatggtatgtgatgtctgcaagtatgagtgtgaaacctataaagagttgaaggcacatggtgtgtcatgcccccagtctcaatgcccttattgctttactcattgtgaacccacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaaatatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaagaaaacctttgtaagataatagacatgaatgactgttttgtatctaggcatgttaaggtctgtataattggtacaatatctaaattctctcagggtgatacattattgtttttcggaccacttgaaggtggcggtctaatatttaaacactggtgcacatccacatgtcaatttggcgacccaggagacattatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagtactatgcactttactgatgaaaggatagagtggaaagaccctgatgggatgctgagggatcatataaacatcttagtaacaaaagacatcgactttgataaccttggtgaaaatccttgcaaaattggcctacaggcatcttccattgagggggcctggggttctggcgtagggtttacattaacatgtctggtatcgctaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggactgttcacaaattggactccatgctgctgcacctcaccttgacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttttattgttctcattggttttactgagcattctctgccccgtgaggaagcataaaaagtcatag

SEQ ID NO: 3298 - RNA, 3408 nt, synthetic construct
  misc_feature 1..3408: note = derived and/or modified CDS sequence (wt) from HTNV(Aa14-172)__KT935008.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattgactgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacataagatgatagaagaatcttaccgcagtagaaaatcaataacctgttatgacctatcatgcaataacacttattgcaagccaacattatacatgattgtaccaattcatgcatgcaatatgatgaaaagctgtttgattgcattaggaccatacagagtacaggtagtttatgagagaacctattgcatgacaggagtcctgattgaaggaaagtgttttgtcccagatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtattatcaggtcctggggcatcatgcgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtgcctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcgatggtatgtgatgtctgcaagtatgagtgtgaaacctataaagagttgaaggcacatggtgtgtcatgcccccagtctcaatgcccttattgctttactcattgtgaacctacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagacttagaacttgatttctctttaacgtctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggttggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatcaacatgtcaatttggcgacccaggagacattatgagcccaagagacaaaggttttttatgccccgagttcccaggtagtttcaggaagaaatgcaactttgctaccactcctatttgtgagtatgacggaaatatggtctcaggttacaagaaagtaatggcaacaattgattcctttcaatcttttaatacaagcactatgcactttactgatgaaaggatagagtggaaagaccctgatgggatgctgagggatcatataaacatcttagtaacaaaagacatcgactttgataaccttggtgaaaatccttgcaaaattggcctgcaaacatcttccattgagggggcttggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggattgttcgcaaattggactccatgctgctgcacctcacctagacaaggtcaatgggatttctgaggtggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtgaggaagcataaaaagtcatag

SEQ ID NO: 3299 - RNA, 3408 nt, synthetic construct
  misc_feature 1..3408: note = derived and/or modified CDS sequence (wt) from HTNV(Aa14-266)__KT935013.1__GP
  source 1..3408: mol_type = other RNA
atggggatatggaagtggctagtgatggccagtttagtatggcctgttttgacactgagaaatgtctatgacatgaaaattgagtgcccccacacagtaagcttcggggaaaatagtgtgataggatatgtggaattaccccccatgccattggctgacacagcacagatggtgcctgagagttcttgcagcatggataatcaccaatcattaaatacaataacaaaatatacccaagtaagttggagaggaaaggctgatcagtcacagtctaaccaaaattcatttgagacagtgtcaactgaagttgacttgaaaggaacatgtgttctgaaacacaagatggtagaagaatcgtaccgaagtagaaagtcaataacctgttatgacctatcatgcaatagcacttattgcaagccaacactatacatgattgtaccaattcatgcatgcaatatgatgaaaagctgcttaattgcactgggaccatacagagtacaggtagtttatgagagaacctattgcatgacaggagtcctgattgaaggaaaatgctttgtcccagatcagagtgtggtcagtattatcaagcatgggatctttgatatcgcaagtgtccatattgtgtgtttctttgtcgcagttaaagggaatacttataaaatttttgaacaggttaagaaatcctttgaatcaacatgcaatgatacagagaataaagtacaggggtattatatctgtattgtagggggaaattctgcaccaatatatgttccaacacttgatgatttcagatccatggaggcattcacagggatctttagatcaccacatggagaagaccatgatctagctggagaagaaattgcaacttactctatagttggacctgccaatgcaaaagttcctcacagtgctagctcagatacattgagcctgattgcctactcaggtataccatcttattcttcccttagcatcctgacaagttcaacagaagccaaacatgtattcagtcctgggttgttcccgaaacttaatcacacaaattgtgataaaagtgccataccactcatgtggactgggatgattgatttacctggatactacgaagctgtccacccctgtacagtcttttgtgtattatcaggtcctggggcatcatgtgaggccttttctgaaggcgggattttcaacataacatcccccatgtgcttagtgtcaaagcaaaatagattccggttaacagaacagcaagtgaattttgtatgtcagcgagtggacgtggacattgttgtgtactgcaatgggcagaggaaagtgatattgacaaagactttagttattggacaatgtatatacactataacaagcttattctcattactgcctggagtagcacattctattgctgttgaattgtgtgtacctggatttcatggatgggccacagctgctctgcttgttacattctgttttggatgggtccttataccagcaatcacatttatcatactaacaatcttaaagttcattgctaatattttccacacaagtaatcaagagaacaggctaaaatcagtacttagaaagataaaggaagagtttgaaaaaacaaaaggctcaatggtatgtgatgtctgcaagtatgagtgtgaaacctataaagaattaaaggcacacggggtgtcatgcccccagtctcaatgcccttattgctttactcattgtgaacccacagaagcagcattccaagcccattacaaagtatgccaagttactcacagattcagggatgatctaaagaaaactgttactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtaggttctgttcccatgcatacagatttagaacttgatttctctttaacatctagttctaagtatacataccgtaggaagctaacaaacccacttgaggaagcacaatccattgatctacatattgaaatagaagaacaaacaattggtgtggatgtacatgccctaggacactggtttgatggtcgtcttaaccttaaaacatcctttcactgttatggtgcttgtacaaagtatgaatacccttggcatactgcaaagtgtcactatgaaagggattaccaatatgaaacaagttggggttgtaacccatcagattgtcctggggtgggcacaggctgtacagcatgtggtttatatctagatcaactgaaaccagttggcagtgcttataaaatcatcacaataaggtatagcaggagagtctgtgttcaatttggggaggaaaacctttgtaagacaatagacatgaatgattgttttgtatctaggcatgttaaggtctgtataattggtacagtatcaaaattctctcagggtgatacattattgtttttcgggccacttgaaggtggtggcctaatatttaaacactggtgcacatccacatgtcaattcggtgacccaggagacatcatgagcccaagagacaaaggttttttatgccctgagttcccaggtagtttcaggaaaaaatgcaactttgctactacccctatttgtgagtatgacggaaatatggtctcaggttacaagaaagtgatggcaacaattgattcctttcaatcttttaatacaagcactatgcactttactgatgaaaggatagagtggaaagaccctgatggaatgctgagggatcatataaacatcttagtaacaaaagacattgactttgataaccttggtgaaaacccttgcaaaattggcctacaaacatcttctattgagggggcctggggttctggtgtgggtttcacattaacatgtctggtatcactaacagaatgtcctaccttcttgacctcaataaaagcttgtgataaggctatctgttatggtgcagagagtgtaacattaacaagaggacaaaatacagttaaggtatcagggaaaggtggccatagtggttcaacatttaagtgttgccatggggaggactgttcacaaattggactccatgctgctgcacctcaccttgacaaggtcaatgggatttctgagatggaaaatagcaaagtatatgatgatggagcaccacagtgtgggataaaatgttggtttgttaaatcaggggaatggatttcagggatattcagtggtaattggattgtactcattgttctctgtgtatttctattgttctcactggttttactaagcattctttgtcccgtaaggaagcataaaaaatcatag

SEQ ID NO: 3300 - RNA, 3408 nt, synthetic construct
  misc_feature 1..3408: note = derived and/or modified CDS sequence (wt) from HTNV(Aa14-272)__KT935014.1__GP
  source 1..3408: mol_type = other RNA
atggggatatggaagtggctagtgatggccagtttagtatggcctgttttgacactgagaaatgtctatgacatgaaaattgagtgcccccacacagtaagcttcggggaaaatagtgtgataggatatgtggaattaccccccatgccattggctgacacagcacagatggtgcctgaaagttcttgcagcatggataatcaccaatcattaaatacaataacaaaatatacccaagtaagttggagaggaaaggctgatcagtcacagtctaaccaaaattcatttgagacagtgtcaactgaagttgacttgaaaggaacatgtgttctgaaacacaagatggtagaagaatcataccgaagtagaaagtcaataacctgttatgacctatcatgcaatagcacttattgcaagccaacactatacatgattgtaccaattcatgcatgcaatatgatgaaaagctgcttaattgcactgggaccatacagagtacaggtagtttatgagagaacctattgcatgacaggagtcctgattgaaggaaaatgctttgtcccagatcagagtgtggtcagtattatcaagcatgggatctttgatatcgcaagtgtccatattgtgtgtttctttgtcgcagttaaagggaatacttataaaatttttgaacaggttaagaaatcctttgaatcaacatgcaatgatacagagaataaagtacaggggtattatatctgtattgtagggggaaattctgcaccaatatatgttccaacacttgatgatttcagatccatggaggcattcacagggatctttagatcaccacatggagaagaccatgatctagctggagaagaaattgcaacttactctatagttggacctgccaatgcaaaagttcctcacagtgctagctcagatacattgagcctgattgcctactcaggtataccatcttattcttcccttagcatcctgacaagttcaacagaagccaaacatgtattcagtcctgggttgttcccgaaacttaatcacacaaattgtgataaaagtgccataccactcatgtggactgggatgattgatttacctggatactacgaagctgtccacccttgtacagtcttttgtgtattatcaggtcctggggcatcatgtgaggccttttctgaaggcgggattttcaacataacatcccccatgtgcttagtgtcaaagcaaaatcgattccggttaacagaacagcaagtgaattttgtatgtcagcgagtggacgtggacattgttgtgtactgcaatgggcagaggaaagtgatattgacaaagactttagttattggacaatgtatatacactataacaagcttattctcattactgcctggagtagcacattctattgctgttgaattgtgtgtacctggatttcatggatgggccacagctgctctgcttgttacattctgttttggatgggtccttataccagcaatcacatttatcatactaacaatcttaaagttcattgctaatattttccacacaagtaatcaagagaacaggctaaaatcagtacttagaaagataaaggaagagtttgaaaaaacaaaaggctcaatggtatgtgatgtctgcaagtatgagtgtgaaacctataaagaattaaaggcacacggggtgtcatgcccccagtctcaatgcccttattgctttactcattgtgaacccacagaagcagcattccaagcccattacaaagtatgccaagttactcacagattcagggatgatctaaagaaaactgttactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtaggttctgttcccatgcatacagatttagaacttgatttctctttaacatctagttctaagtatacataccgcaggaagctaacaaacccacttgaggaagcacaatccattgatctacatattgaaatagaagaacaaacaattggtgtggatgtacatgccctaggacactggtttgatggtcgtcttaaccttaaaacatcctttcactgttatggtgcttgtacaaagtatgaatacccttggcatactgcaaagtgtcactatgaaagggattaccaatatgaaacaagttggggttgtaacccatcagattgtcctggggtgggcacaggctgtacagcatgtggtttatatctagatcaactgaaaccagttggcagtgcttataaaatcatcacaataaggtatagcaggagagtctgtgttcaatttggggaggaaaacctttgtaagataatagacatgaatgattgttttgtatctaggcatgttaaggtctgtataattggtacagtatcaaaattctctcagggtgatacattattgtttttcgggccacttgaaggtggtggcctaatatttaaacactggtgcacatccacatgtcaattcggtgacccaggagacatcatgagcccaagagacaaaggttttttatgccctgagttcccaggtagtttcaggaaaaaatgcaactttgctactacccctatttgtgagtatgacggaaatatggtctcaggttacaagaaagtgatggcaacaattgattcctttcaatcttttaatacaagcactatgcactttactgatgaaaggatagagtggaaagaccctgatggaatgctgagggatcatataaacatcttagtaacaaaagacattgactttgataaccttggtgaaaacccttgcaaaattggcctacaaacatcttctattgagggggcctggggttctggtgtgggtttcacattaacatgtctggtatcactaacagaatgtcctaccttcttgacctcaataaaagcttgtgataaggctatctgttatggtgcagagagtgtaacattaacaagaggacaaaatacagttaaggtatcaggaaaaggtggccatagtggttcaacatttaagtgttgccatggggaggactgttcacaaattggactccatgctgctgcacctcaccttgacaaggtcaatgggatttctgagatggaaaatagcaaagtatatgatgatggagcaccacagtgtgggataaaatgttggtttgttaaatcaggggaatggatttcagggatattcagtggtaattggattgtactcattgttctctgtgtatttctattgttctcactggttttactaagcattctttgtcccgtaaggaagcataaaaaatcatag

SEQ ID NO: 3301 - RNA, 3408 nt, synthetic construct
  misc_feature 1..3408: note = derived and/or modified CDS sequence (wt) from HTNV(Aa14-362)__KT935015.1__GP
  source 1..3408: mol_type = other RNA
atggggatatggaagtggctagtgatggccagtttagtatggcctgttttaacactgagaaatgtctatgatatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgaggcagtgtctactgaagttgacttgaaaggaacatgtgttctgaaacataagatggtagaagaatcttaccgcagtagaaaatcaataacctgttatgacctatcatgcaatagcacttattgcaagccaacactatacatgattgtaccaattcatgcatgcaatatgatgaaaagctgtttgattgcattgggaccatacagagtacaagtagtttatgagagaacctattgcatgacaggagtcctaattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcatttgaatcaacatgcaatgatacagagaataaagtgcaggggtattatatctgtattgtaggaggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcctcccttagcatcctgacaagttcaacagaagccaaacatgtattcagccctgggttgtttccaaaacttaatcacacaaattgtgataaaggtgccataccactcatgtggactgggatgattgatttacctggatactatgaggctatccacccctgtacagtattttgtgtattatcaggtcctggggcatcatgtgaggccttttctgaaggcgggattttcaacataacctcccccatgtgcttagtatcaaagcaaaatcgattccggttaacagaacagcaagtgaattttgtatgtcagcgagtggacgtggacatcattgtgtactgcaatgggcagagaaaagtaatattgacaaaaactttagttattggacaatgtatatacactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcaatggtatgtgatgtctgcaagtatgagtgtgaaacctataaagagttaaaggcacatggtgtgtcatgcccccagtctcaatgcccttactgctttactcattgtgaacccacagaagcagcattccaggcccattacaaagtatgccaagttactcacaggtttagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccactgactcctgtctggaatgacaatgcccatggagtaggttctgttcctatgcacacagatttagaacttgatttctctttgacatctagttccaagtatacataccgtaggaagctaacaaacccacttgaagaagcacaatccattgatctacatattgaaatagaagaacaaacaattggtgtggatgtgcatgctctaggacactggtttgatggtcgtcttaacctcaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaagcactggtgcacatccacatgtcaatttggcgacccaggagacatcatgagcccaagagacaaaggttttttatgccctgagttcccaggtagtttcaggaagaaatgcaactttgctaccactcctatttgtgagtatgacggaaatatggtctcaggttacaagaaagtaatggcaacaattgattccttccagtcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctacaaacatcttccatagagggggcctggggttctggtgtagggtttacattaacatgcctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcgcaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtaaggaagcataaaaaatcatag

SEQ ID NO: 3302 - RNA, 3408 nt, synthetic construct
  misc_feature 1..3408: note = derived and/or modified CDS sequence (wt) from HTNV(Aa14-404)__KT935018.1__GP
  source 1..3408: mol_type = other RNA
atggggatatggaagtggctagtgatggccagtttagtatggcctgttttgacactgagaaatgtctatgacatgaaaattgagtgcccccacacagtaagcttcggggaaaatagtgtgataggctatgtggaattaccccccatgccattggctgacacagcacagatggtgcctgagagttcttgcagcatggataatcaccaatcattaaatacaataacaaaatatacccaagtaagctggagaggaaaggctgatcagtcacagtctagccagaactcatttgagacagtgtctactgaagttgacttgaaaggaacatgtgttctgaaacacaagatggtagaagaatcgtaccgcagtagaaaatcaataacctgttatgacctatcatgcaatagcacttattgcaagccaacactatacatgattgtaccaattcatgcatgcaatatgatgaaaagctgtttgattgcattgggaccatacagagtacaggtagtttatgagagaacctattgcatgacaggagttctgattgaaggaaaatgctttgtcccagatcagagtgtagtcagtattatcaagcatgggatctttgatatcgcaagtgttcatattgtttgtttctttgttgcagttaaaggaaatacttataaaatttttgaacaggttaaaaaatcctttgaatcaacatgcaatgatacagagaataaagtgcagggttattatatctgtatcgtagggggaaactctgcaccaatatatgttccaacacttgatgatttcagatccatggaagcattcacaggaatttttagatcaccacatggagaagaccatgatctagctggagaagaaattgcaacttactctatagttggacctgccaatgcaaaagttcctcacagtgctagctcagatacattaagtctgattgcctactcaggtataccatcttattcttcccttagcatcctgacaagttcaacagaagccaaacatgtattcagccctgggttgttcccaaagcttaatcacacaaattgtgataaaagtgccataccactcatgtggactgggatgattgatttacctggatactatgaagctgtccacccttgtacagtcttttgtgtattatcaggtcctggggcatcatgtgaggccttttctgaaggcgggattttcaacataacctcccccatgtgcttagtgtcaaagcaaaatcgattccggttaacagaacagcaagtgaattttgtatgtcagcgagtggacgtggacattgttgtgtactgcaatgggcagaggaaagtgatattgacaaaaactttagttattggacaatgtatatacactataacaagcttattctcattactgcctggagtagcacattctattgctgttgaattgtgtgtacctggatttcatggatgggccacagctgctctgcttgttacattctgttttggatgggttcttataccagcaatcacatttatcatactgacaatcctaaagttcattgctaatattttccacacaagtaaccaagagaacaggctaaaatcagtacttagaaagataaaggaagagtttgaaaaaacaaaaggctcaatggtatgtgatgtctgcaagtatgagtgtgaaacctataaagaattaaaggcacacggggtgtcatgcccccagtctcaatgcccttattgctttactcattgtgaacccacagaagcaacattccaagcccattacaaagtatgccaagttactcacaggttcagggatgacctaaagaaaactgtcactcctcaaaacttcacaccaggatgttaccgtacactgaatttatttagatacaaaagtaggtgctacatctttacaatgtggatattccttcttgtcctagaatctatactatgggctgcaagtgcatcagagacaccattgactcctgtatggaatgacaacgcccatggagtaggttctgttcctatgcatacagatttagaacttgatttctctttgacatctagttccaagtatacataccgtaggaagctaacaaacccacttgaggaagcacaatccattgatctacatattgaaatagaagaacaaacaattggtgtggatgtacatgctctaggacactggtttgatggtcgtcttaaccttaaaacgtcctttcactgctatggtgcttgtacaaagtatgaatacccttggcatactgcaaagtgccactatgaaagggattaccaatatgagacaagttggggttgtaatccatcagattgtcctggggtgggcacaggctgtacagcatgtggcttatatctagaccagctaaaaccagtcggcagtgcttataaaatcatcacaataaggtatagcaggagagtctgtgttcagtttggggaggaaaacctttgtaagatcatagacatgaatgactgttttgtatctaggcatgttaaggtctgtataattggtacagtatctaaattctctcagggtgatacattattgtttttcgggccacttgagggtggtggtctaatatttaagcactggtgcacatccacatgtcaatttggcgacccaggagacatcatgagcccacgagacaaaggttttttatgccctgagttcccaggtagtttcaggaaaaaatgcaactttgctactacccctctttgtgagtatgacggaaatatggtctcaggttacaagaaagtgatggcaacaattgattcctttcaatcttttaatacaagcactatgcactttactgatgaaaggatagaatggaaagaccctgatggaatgctaagggatcatataaacatcttagtaacaaaagacattgactttgataaccttggtgaaaatccttgcaaaattggcctacaaacatcttctattgaaggggcctggggttctggtgtggggtttacattaacatgtctggtatcattaacagaatgtcctacctttttgacctcaataaaggcttgtgataaggctatctgttatggtgcagagagtgtaacattgacaagaggacaaaatacagtcaaggtatcaggaaaaggtggccatagtggttcaacatttaagtgttgccatggagaggactgttcgcaaattggactccatgctgctgcaccccaccttgacaaggtcaatgggatttctgagatggaaaatagcaaagtatatgatgatggagcaccgcaatgtgggataaaatgttggtttgttaaatcaggggaatggatttcagggatattcagtggtaactggattgtactcattgtcctctgtgtgtttctattgttctcattggttttactaagcattctctgtcccgtaaggaagcataaaaaatcatag

SEQ ID NO: 3303 - RNA, 3408 nt, synthetic construct
  misc_feature 1..3408: note = derived and/or modified CDS sequence (wt) from HTNV(Aa14-423)__KT935022.1__GP
  source 1..3408: mol_type = other RNA
atggggatatggaagtggctagtgatggccagtttagtatggcctgttttgacactgagaaatgtctatgacatgaaaattgagtgcccccacacagtaagcttcggggaaaatagtgtgataggctatgtggaattaccccccatgccattggctgacacagcacagatggtgcctgagagttcttgcagcatggataatcaccaatcattaaatacaataacaaaatatacccaagtaagctggagaggaaaggctgatcagtcacagtctagccagaactcatttgagacagtgtctactgaagttgacttgaaaggaacatgtgttctgaaacacaagatggtagaagaatcgtaccgcagtagaaaatcaataacctgttatgacctatcatgcaatagcacttattgcaagccaacactatacatgattgtaccaattcatgcatgcaatatgatgaaaagctgtttgattgcattgggaccatacagagtacaggtagtttatgagagaacctattgcatgacaggagttctgattgaaggaaaatgctttgtcccagatcagagtgtagtcagtattatcaagcatgggatctttgatatcgcaagtgttcatattgtttgtttctttgttgcagttaaaggaaatacttataaaatttttgaacaggttaaaaaatcctttgaatcaacatgcaatgatacagagaataaagtgcagggttattatatctgtatcgtagggggaaactctgcaccaatatatgttccaacacttgatgatttcagatccatggaagcattcacaggaatttttagatcaccacatggagaagaccatgacctagctggagaagaaattgcaacttactctatagttggacctgccaatgcaaaagttcctcacagtgctagctcagatacattaagtctgattgcctactcaggtataccatcttattcttcccttagcatcctgacaagttcaacagaagccaaacatgtattcagccctgggttgttcccaaagcttaatcacacaaattgtgataaaagtgccataccactcatgtggactgggatgattgatttacctggatactatgaagctgtccacccttgtacagtcttttgtgtattatcaggtcctggggcatcatgtgaggccttttctgaaggcgggattttcaacataacctcccccatgtgcttagtgtcaaagcaaaatcgattccggttaacagaacagcaagtgaattttgtatgtcagcgagtggacgtggacattgttgtgtactgcaatgggcagaggaaagtgatattgacaaaaactttagttattggacaatgtatatacactataacaagcttattctcattactacctggagtagcacattctattgctgttgaattgtgtgtacctggatttcatggatgggccacagctgctctgcttgttacattctgttttggatgggttcttataccagcaatcacacttatcatactgacaatcctaaagttcattgctaatattttccacacaagtaaccaagagaacaggctaaaatcagtacttagaaagataaaggaagagtttgaaaaaacaaaaggctcaatggtatgtgatgtctgcaagtatgagtgtgaaacctataaagaattaaaggcacacggggtgtcatgcccccagtctcaatgcccttattgctttactcattgtgaacccacagaagcaacattccaagcccattacaaagtatgccaagttactcacaggttcagggatgacctaaagaaaactgtcactcctcaaaacttcacaccaggatgttaccgtacactgaatttatttagatacaaaagtaggtgctacatctttacaatgtggatattccttcttgttctagaatctatactatgggctgcaagtgcatcagagacaccattgactcctgtatggaatgacaacgcccatggagtaggttctgttcctatgcatacagatttagaacttgatttctccttgacatctagttccaagtatacataccgtaggaagctaacaaacccacttgaggaagcacaatccattgatctacatattgaaatagaagaacaaacaattggtgtggatgtacatgctctaggacactggtttgatggtcgtcttaaccttaaaacatcctttcactgctatggtgcttgtacaaagtatgaatacccttggcatactgcaaagtgccactatgaaagggattaccaatatgagacaagttggggttgtaatccatcagattgtcctggggtgggcacaggctgtacagcatgtggcttatatctagaccagctaaaaccagtcggcagtgcttataaaatcatcacaataaggtatagcaggagagtctgtgttcagtttggggaggaaaacctttgtaagatcatagacatgaatgactgttttgtatctaggcatgttaaggtctgtataattggtacagtatctaaattctctcagggtgatacattattgtttttcgggccacttgagggtggtggtctaatatttaagcactggtgcacatccacatgtcaatttggcgacccaggagacatcatgagcccacgagacaaaggttttttatgccctgagttcccaggtagtttcaggaaaaaatgcaactttgctactacccctctttgtgagtatgacggaaatatggtctcaggttacaagaaagtgatggcaacaattgattcctttcaatcttttaatacaagcactatgcactttactgatgaaaggatagaatggaaagaccctgatggaatgctaagggatcatataaacatcttagtaacaaaagacattgactttgataaccttggtgaaaatccttgcaaaattggcctacaaacatcttctattgaaggggcctggggttctggtgtggggtttacattaacatgtctggtatcattaacagaatgtccgacctttttgacctcaataaaggcttgtgataaggctatctgttatggtgcagagagtgtaacattgacacgaggacaaaatacagtcaaggtatcaggaaaaggtggccatagtggttcaacatttaagtgttgccatggagaggactgttcgcaaattggactccatgctgctgcaccccaccttgacaaggtcaatgggatttctgagatggaaaatagcaaagtatatgatgatggagcaccgcaatgtgggataaaatgttggtttgttaaatcaggggaatggatttcagggatattcagtggtaactggattgtactcattgtcctctgtgtgtttctattgttctcattggttttactaagcattctctgtcccgtaaggaagcataaaaaatcatag

SEQ ID NO: 3304 - RNA, 3408 nt, synthetic construct
  misc_feature 1..3408: note = derived and/or modified CDS sequence (wt) from HTNV(Aa15-56)__KU207187.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataaccaaatatacccaagtaagttggagaagaaaggctgatcagtcacagtctagccaaaattcatttgagacagtgtctactgaagttgacttgaaaggaacatgtgttctgaaacacaagatggtggaagaatcttaccgcagtagaaaatcaataacctgttatgacctatcatgcaatagcacttattgcaagccaacactatacatgattgtaccaattcatgcttgcaacatgatgaaaagctgtttgattgcattgggaccatacagagtacaggtagtttatgagagaacctattgcatgacaggagccctgattgaaggaaaatgttttgtccctgatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatttgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggctgttcccaaaacttaatcacacaaattgtgataaaggtgccataccactcatgtggactgggatgattgatttacctggatactatgaagctatccacccttgtacagtattttgtgtattatcagggcctggggcatcatgtgaggccttttctgaaggcgggattttcaacataacctcccccatgtgcttagtgtcaaagcaaaatcgattccggttaacagaacagcaagtaaattttgtatgtcagcgagtggatgtggacatcgttgtgtactgcaatgggcagagaaaagtaatattaacaaaaactttagttattggacaatgtatatatactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagagaacaggctaaaatcagtacttagaaagataaaggaagagtttgaaaaaacaaaaggctcaatggtatgtgatgtctgcaagtatgagtgtgaaacctacaaagagttaaaggcacacggggtgtcatgcccccagtctcaatgcccttattgctttactcattgtgaacccacagaagcagcattccaagcccattacaaagtttgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaacgacaatgcccatggagtaggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtctcaaccttaaaacatcatttcactgttatggtgcctgtacaaagtatgaatacccttggcatactgcaaagtgccactatgaaagggattaccaatatgagacaagttggggttgtaatccatcagattgtcccggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaagttctctcagggtgatacattattgtttttcggaccacttgaaggtggtggtctaatatttaaacactggtgcacatccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcttttcaatcttttaatacaagcactatgcactttactgatgaaagaatagagtggaaagaccctgatggaatgctaagggatcatataaacatcttagtaacaaaagacatcgactttgataaccttggtgaaaatccttgcaaaattggcctacaaacatcttccattgaaggggcctggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcgcaaattggactccatgctgctgcacctcacctagacaaggtaaatgggatttctgagatggaaaatagcaaagtatatgatgatggggcaccgcaatgtgggataaaatgttggtttgttaagtcaggggaatggatttcagggatattcagtggtaattggattgtactcattgttctctgcgtatttctattgttctcattggttttactgagcattctctgtcccgtaaggaagcataaaaagtcataa

SEQ ID NO: 3305 - RNA, 3408 nt, synthetic construct
  misc_feature 1..3408: note = derived and/or modified CDS sequence (wt) from HTNV(CBAa11-106)__KC576787.1__GP
  source 1..3408: mol_type = other RNA
atggggatgtggaagtggctagtgatagccagtttagtatggcctgctttgacactgagaaatgtatatgacatgaaaattgaatgcccccacacagtgagtttcggagaaaacagtgtgataggttatgtggagttaccccctatgccattggccgacacagcacagatggtgcctgaaagttcttgcagcatggacaatcatcaatcgatgaatacaataacaaaatatacccaggtaatctggagaggaaaggcagatccaggacaatccagtcagaattcatttgaaacagtatctactgaaattgacttgaaaggaacgtgtgttttaaaacataaaatggtggaagagtcatatcgcagccggaagtcaataacctgttatgacctttcttgtaatagtacttattgcaagccaacattgtatatgatcgtaccgatccatgcatgcaatatgatgaaaagctgtctaattgcattagggccatacagggtacaggtagtgtatgaaagaacctactgcatgacaggggtcctgattgaaggaaaatgttttgtcccagatcaaagtgtagtcagtattattaagcatgggatctttgatattgcaagtgttcatatagtatgtttctttgttgcagttaaagggaacacctataaactctttgaacaggtcaagaaatcatttgagtcaacttgcaatgacactgagaataaagtgcagggttattacatttgcattgtgggaggaaattttgcaccgatttatgtccctacgcttgatgattttaggtccatggaggcattcacagggatctttagatcaccacatggagaagaccatgatctggctggggaagagattgcttcatactctatagtcggacctgccaatgcaaaagtccctcatagtgcaagctcggatacattgagcctaattgcttattcaggtataccatcttattcttccctgagtatcttgacaagttcaacagaggctaagcatgtatttagccctgggttgttcccaaagcttaaccatacaaactgtgataagagtgctataccgctcacatggactgggatgattgacttacctggatactatgaggccatacacccttgtacagttttttgtgtactatcaggccctggagcatcatgtgaggcattttctgaaggtggaatttttaacataacttcccctatgtgcttagtttcaaaacagaatcggtttcggctaacagagcagcaggtaaactttgtgtgtcaaagagtagacatggacattgtcgtgtactgcaatggacagcggaaagtaatattaacaaaaactttagttattgggcagtgtatatacactataacaagcttgttttcattactacctggggtagcacattctattgctgtggagctatgtgtacctgggtttcatggctgggccacagctgctttgcttgttacattctgctttggatgggtcctgataccagcaatcacatttattatactaacagtcttaaagtttgttgccaacattttccacacaagcaaccaagagaacaggttaaaatcagtattgagaaaaataaaggaggagtttgaaaagacaaagggttcaatggtatgtgatgtttgcaagtatgaatgtgaaacctataaagaattgaaggcacatggggtgtcttgtccccaatctcaatgcccttactgttttactcattgtgagcctacagaggcagcatttcaagcccactataaagtctgtcaggttactcataggttcagggatgatcttaaaaagactgtcacgcctcaaaactttacaccagggtgttatcggacattaaatttatttagatacaagagcagatgttacatttttacaatgtgggtctttcttctcattctagaatctgtactgtgggctgctagtgcatcagaaacaccgttaactcctgtttggaatgataatgcccatggtgtaggttctgtgcctatgcacacagatcttgagcttgatttttctctaacatccagttctaagtatacatatcgcagaaagctaacaaacccactggaagaggcacaatcaattgatctccatattgaaatagaagagcaaacaatcggtgttgatgtgcatgctctaggacattggtttgatggccgtctcaaccttaaaacatcctttcactgttatggtgcctgtacaaagtatgagtatccatggcatactgcaaagtgtcactatgaacgagattaccaatatgagacaagttggggctgtaatccatcagactgccccggggtaggtacaggctgtacagcatgtgggctttatcttgaccagttaaaaccagttggtagtgcatataaaatcattacaataagatatagtagaagagtctgtgttcaatttggagaagaaaacctttgtaaaatcatagacatgaatgattgttttgtatctagacatgttaaagtctgtatcatcgggacagtttctaagttttcacaaggtgatacactattatttttcgggccacttgagggtggtggcttgatatttaaacattggtgcacatctacatgtcagttcggtgaccccggagatatcatgagtccaagggacaagggttttttatgccctgagttcccaggtagttttaggaaaaaatgtaattttgctactacccctatctgtgagtatgatggaaatatggtctcaggttacaaaaaagtgatggcaacaattgactctttccaatccttcaacacaagcactatgcacttcactgatgagaggatagagtggaaagaccctgatggaatgttaagggaccatataaatattttagtaacaaaggatattgattttgataatctgggtgaaaacccctgcaaaattggcttgcagacatcttctattgaaggggcatggggttctggtgtaggctttacacttacatgtttagtatcattgacagagtgtcctacttttttaacctccattaaggcctgtgacaaagctatttgttatggtgcagaaagtgtgacactaaccagaggacaaaatacagtaaaggtgtcaggaaaaggtggtcatagtggttcaactttcaaatgttgccacggggaagactgttcacaaattgggctccatgctgctgcaccccaccttgataaagttaatgggatttctgaaatagaaaacagtaaagtatatgatgatggagcaccacaatgtggtataaaatgttggtttgtcaaatcaggggaatggatctcagggatatttagtggtaactggattgtgctcattgtcctctgtgtattcttactgttttcattggtcttactcagtatcctttgccctgtcaggaagcataaaaaatcatag

SEQ ID NO: 3306 - RNA, 3408 nt, synthetic construct
  misc_feature 1..3408: note = derived and/or modified CDS sequence (wt) from HTNV(CBAa11-26)__KC576786.1__GP
  source 1..3408: mol_type = other RNA
atggggatgtggaagtggctagtgatagccagtttagtatggcctgctttgacactgagaaatgtatatgacatgaaaattgaatgcccccacacagtgagtttcggagaaaacagtgtgataggttatgtggagttaccccctatgccattggccgacacagcacagatggtgcctgaaagttcttgcagcatggacaatcatcaatcgatgaatacaataacaaaatatacccaggtaatctggagaggaaaggcagatccaggacaatccagtcagaattcatttgaaacagtatctactgaaattgacttgaaaggaacgtgtgttttaaaacataaaatggtggaagagtcatatcgcagccggaagtcaataacctgttatgacctttcttgtaatagtacttattgcaagccaacattgtatatgatcgtaccgatccatgcatgcaatatgatgaaaagctgtctaattgcattagggccatacagggtacaggtagtgtatgaaagaacctactgcatgacaggggtcctgattgaaggaaaatgttttgtcccagatcaaagtgtagtcagtattattaagcatgggatctttgatattgcaagtgttcatatagtatgtttctttgttgcagttaaagggaacacctataaactctttgaacaggtcaagaaatcatttgagtcaacttgcaatgacactgagaataaagtgcagggttattacatctgcattgtgggaggaaattctgcaccgatttatgtccctacgcttgatgattttaggtccatggaggcattcacagggatctttagatcaccacatggagaagaccatgatctggctggggaagagattgcttcatactctatagtcggacctgccaatgcaaaagtccctcatagtgcaagctcggatacattgagcctaattgcttattcaggtataccatcttattcttccctgagtatcttgacaagttcaacagaggctaagcatgtatttagccctgggttgttcccaaagcttaaccatacaaactgtgataagagtgctataccgctcacatggactgggatgattgacttacctggatactatgaggccatacacccttgtacagttttttgtgtactatcaggccctggagcatcatgtgaggcattttctgaaggtggaatttttaacataacttcccctatgtgcttagtttcaaaacagaatcggtttcggctaacagagcagcaggtaaactttgtgtgtcaaagagtagacatggacattgtcgtgtactgcaatggacagcggaaagtaatattaacaaaaactttagttattgggcagtgtatatacactataacaagcttgttttcattactacctggggtagcacattctattgctgtggagctatgtgtacctggatttcatggctgggccacagctgctttgcttgttacattctgctttggatgggtcctgataccagcaatcacatttattatactaacagtcttaaagtttgttgccaacattttccacacaagcaaccaagagaacaggttaaaatcagtattgagaaaaataaaggaggagtttgaaaagacaaagggttcaatggtatgtgatgtttgcaagtatgaatgtgaaacctataaagaattgaaggcacatggggtgtcttgtccccaatctcaatgcccttactgttttactcattgtgagcctacagaggcagcatttcaagcccactataaagtctgtcaggttactcataggttcagggatgatcttaaaaagactgtcacgcctcaaaactttacaccagggtgttatcggacattaaatttatttagatacaagagcagatgttacatttttacaatgtgggtctttcttctcattctagaatctgtactgtgggctgctagtgcatcagaaacaccgttaactcctgtttggaatgataatgcccatggtgtaggttctgtgcctatgcacacagatcttgagcttgatttttctctaacatccagttctaagtatacatatcgcagaaagctaacaaacccactggaagaggcacaatcaattgatctccatattgaaatagaagagcaaacaatcggtgttgatgtgcatgctctaggacattggtttgatggccgtctcaaccttaaaacatcctttcactgttatggtgcctgtacaaagtatgagtatccatggcatactgcaaagtgtcactatgaacgagattaccaatatgagacaagttggggctgtaatccatcagactgccccggggtaggtacaggttgtacagcatgtgggctttatcttgaccagttaaaaccagttggtagtgcatataaaatcattacaataagatatagtagaagagtctgtgttcaatttggagaagaaaacctttgtaaaatcatagacatgaatgattgttttgtatctagacatgttaaagtctgtatcatcgggacagtttctaagttttcacaaggtgatacactattatttttcgggccacttgagggtggtggcttgatatttaaacattggtgcacatctacatgtcagtttggtgacccaggagatatcatgagtccaagggacaagggttttttatgccctgagttcccaggtagttttaggaaaaaatgtaattttgctactacccctatctgtgagtatgatggaaatatggtctcaggttacaaaaaagtgatggcaacaattgactctttccaatccttcaacacaagcactatgcacttcactgatgagaggatagagtggaaagaccctgatggaatgttaagggaccatataaatattttagtaacaaaggatattgattttgataatctgggtgaaaacccctgcaaaattggcttgcagacatcttctattgaaggggcatggggttctggtgtaggctttacacttacatgtttagtatcattgacagagtgtcctacttttttaacctccattaaggcctgtgacaaagctatttgttatggtgcagaaagtgtgacactaaccagaggacaaaatacagtaaaggtgtcaggaaaaggtggtcatagtggttcaactttcaaatgttgccacggggaagactgttcacaaattgggctccatgctgctgcaccccaccttgataaagttaatgggatttctgaaatagaaaacagtaaagtatatgatgatggagcaccacaatgtggtataaaatgttggtttgtcaaatcaggggaatggatctcagggatatttagtggtaactggattgtgctcattgtcctctgtgtattcttactgttttcattggtcttacttagtatcctttgccctgtcaggaagcataaaaaatcatag

SEQ ID NO: 3307 - RNA, 3408 nt, synthetic construct
  misc_feature 1..3408: note = derived and/or modified CDS sequence (wt) from HTNV(Fuyuan-Aa-145)__KJ857336.1__GP
  source 1..3408: mol_type = other RNA
atggggatgtggaagtggctagtaatagccagtttagtatggcctgctttgtcactgagaaatgtgtatgacatgaaaattgaatgcccccacacagtaagtttcggagaaaacagtgtaatagggtatgtggagttaccccctatgccgttggctgatacagcacagatggtgcctgagagttcttgcagcatggataatcatcagtcaataaatactataacaaaatacacccaagtaatctggagaggaaaggcagatccgggacaatccagtcaaaattcatttgaaacagtgtctactgaagttgacttgaaaggaacatgtgttttaaagcataagatggtggaagaatcataccgcagccggaagtcaataacctgttatgacctttcttgtaatagtactttttgcaagccaacattatatatgattgtaccgatccatgcatgtaatatgatgaagagctgtctaattgcattagggccatacagagtgcaggtagtgtatgagagaacctactgtatgacaggagtcttgattgaaggaaaatgttttgtcccagatcaaagtgttgttagcattattaagcatgggatctttgatattgcaagtgttcatgttgtatgtttctttgttgcagttaaagggaacacctataaactctttgaacaggttaagaaatcgtttgagtcaacttgcaatgatactgagaataaagtacagggttattacatctgtattgtgggaggaaattctgcaccgatctatgtccctacacttgatgatttcaggtccatggaggcatttacgggaatcttcaaatcaccgcatggagaagaccatgatcttgctggggaggagattgcttcatactctatagtcggacctgcaaatgcaaaagtccctcatagtgcaagctcagacacactgagtctaattgcttattcaggtataccatcttattcttccctgagtatcttgacaagttcaacagatgctaagcatgtgtttagccctgggttgttcccaaagcttaatcatacaaactgtgataagagtgcaataccgcttacatggactgggatgattgatttacctggatactatgaggccatacacccttgcacagttttttgtgtattgtcaggccctggagcatcatgtgaagcattttctgaaggtggaattttcaatataacttcccccatgtgcttagtttcaaagcaaaatcggttccggctaacagagcagcaagtaaactttgtgtgtcaaagagtagacatggacattgttgtgtactgcaacggacagcggaaagtaatattaacaaaaactttagttattgggcaatgtatatatactataacaagcttgttctcactactacctggagtagcacattctattgctgtagaactatgtgtgcctggattccatggctgggccacagctgctttgcttgttacattctgttttggatgggtccttataccagctgtcacatttattatactaacagtcttaaagtttattgctaacatttttcacacaagcaaccaagagaacaggttaaaatcagtattgagaaaaataaaggaggaatttgaaaagacaaagggttcaatggtatgtgatgtttgcaagtatgaatgtgaaacctataaagaattaaaggcacatggggtatcttgtccccaatctcaatgcccttactgttttactcattgtgagcctacagaggcagcatttcaagcccactataaagtatgccaggttactcacaggttcagggatgatcttaaaaagactgtcactcctcagaatttcacaccaggttgttatcggacattaaatttatttagatacaaaagtagatgttacatttttacaatgtgggtattccttctcattctggaatctgtactgtgggctgctagtgcatcagagacacctttaactcctgtttggaatgacaatgcccatggtgttggttctgtgcctatgcacacagatctggagcttgatttttctctgacatccagttctaagtacacatatcgcaggaagctaacaaacccactggaagaggcacaatcaattgatctccatattgaaatagaagagcaaacaatcggtgttgatgtgcatgctctaggacattggtttgatggccgtcttaatcttaaaacatccttccactgttacggtgcttgtacaaagtacgagtacccatggcacactgcaaagtgtcactatgaacgagattaccaatatgagacaagttggggctgtaatccatcagactgccccggggtgggtacaggctgtacagcatgtgggctttatcttgaccagttaaagccagttggcagtgcatataaaatcattacaataagatatagtagaagagtctgtgttcagtttggagaagaaaacctttgcaaaattatagacatgaatgactgctttgtatctagacatgttaaagtctgtatcattgggacagtttctaagttttcacaaggtgatacactattgtttttcgggccacttgaaggcggtggattgatatttaaacactggtgtacatctacatgtcagtttggtgacccaggagacatcatgagcccaagagacaaaggttttttatgccctgagttcccaggtagttttaggaaaaaatgtaattttgctactactcctatttgtgaatatgatggaaatatggtctcaggttacaagaaagtgatggcaacaattgactctttccaatccttcaatacaagcactatgcactttactgatgagaggatagaatggaaagaccctgatggaatgttgagggaccatataaatattttagtaacaaaggatattgattttgataatcttggtgaaaacccctgtaaaattggcttgcagacatcttctattgaaggggcatggggttctggtgtaggctttacacttacatgcttggtatcattaacagagtgtcctacttttttaacctccattaaggcctgtgataaagctatttgttacggtgcagaaagtgtaacattaacaagaggacaaaatacagtgaaggtatcaggaaaaggcggtcacagtggttcaactttcaaatgttgccatggggaagactgctcaaagattgggctccatgctgctgcaccccaccttgataaagttaacgggatctctgaaatagaaaacagtaaagtatatgatgatggagcaccacaatgtggtataaaatgttggtttgtcaaatcaggggaatggatttcagggatatttagtggcaattggattgtgctcattgtcctctgtgtcttcttgctgttttcattggtcttactcagtatcctttgccctgtcaggaagcataagaaatcatag

SEQ ID NO: 3308 - RNA, 3408 nt, synthetic construct
  misc_feature 1..3408: note = derived and/or modified CDS sequence (wt) from HTNV(Fuyuan-Aa-26)__KJ857334.1__GP
  source 1..3408: mol_type = other RNA
atggggatgtggaagtggctagtaatagccagtttagtatggcctgctttgtcactgagaaatgtgtatgacatgaaaattgaatgcccccacacagtaagtttcggagaaaacagtgtaatagggtatgtggaattaccccctatgccgttggctgatacagcacagatggtgcctgagagttcttgcagcatggataatcatcagtcaataaatactataacaaaatacacccaggtaatctggagaggaaaggcagatccgggacaatccagtcaaaattcatttgaaacagtgtctactgaagttgacttgaaaggaacatgtgttttaaagcataagatggtggaagaatcataccgcagccggaagtcaataacctgttatgacctttcttgtaatagtacttattgcaagccaacattatatatgattgtaccgatccatgcatgtaatatgatgaagagctgtctaattgcattagggccatacagagtgcaggtagtgtatgagaggacctactgtatgacaggagtattaattgaaggaaaatgttttgtcccagatcaaagtgttgttagcattattaagcatgggatctttgatattgcaagtgttcatattgtatgtttctttgtcgcagttaaagggaacacctataaactctttgaacaggttaagaaatcgtttgagtcaacttgcaatgatactgagaataaagtacagggttattacatctgtattgtgggaggaaattctgcaccgatctatgtccctacacttgatgatttcaggtccatggaggcatttacgggaatcttcaaatcaccgcacggagaagaccatgatcttgctggggaggagattgcttcatactctatagtcggacctgcaaatgcaaaagtccctcatagtgcaagctcagacacactgagtctaattgcttattcaggtataccatcttattcttccctgagtatcttgacaagttcaacagatgctaagcatgtgtttagccctgggttgttcccaaagcttaatcatacaaactgtgataagagtgcaataccgcttacatggactgggatgattgatttacctggatactatgaggccatacacccttgcacagttttttgtgtattgtcaggccctggagcatcatgtgaagcattttctgaaggtgggattttcaacataacttcccccatgtgcttagtttcaaagcaaaatcggttccggctaacagagcagcaggtaaactttgtgtgtcaaagagtagacatggacattgttgtgtactgcaacggacagaggaaagtaatattaacaaaaactttagttattgggcaatgtatatatactataacaagcttgttctcactactacctggagtagcacattctattgctgtagaactatgtgtgcctggattccatggctgggccacagctgctttgcttgttacattctgttttggatgggtccttataccagctgtcacatttattatactaacagtcttaaagtttattgctaacatttttcacacaagcaaccaagagaacaggttaaaatcagtattgagaaaaataaaggaggaatttgaaaagacaaagggttcaatggtatgtgatgtttgcaagtatgaatgtgaaacctataaagaattaaaggcacatggggtatcttgtccccaatctcaatgcccttactgttttactcattgtgagcctacagaggcagcatttcaagcccactataaagtatgccaggttactcataggttcagggatgatcttaaaaagactgtcactcctcagaatttcacaccaggttgttatcggacattaaatttatttagatacaaaagtagatgttacatttttacaatgtgggtattccttctcattctggaatctgtactgtgggcagctagtgcatcagagacaccgttaactcctgtttggaatgacaatgcccatggtgttggttctgtgcctatgcacacagatctggagcttgatttttctctgacatccagttctaagtacacatatcgcaggaagctaacaaacccactggaagaggcacaatcaattgatctccatattgaaatagaagagcaaacaatcggtgttgatgtgcatgctctaggacattggtttgatggccgtcttaatcttaaaacatccttccactgttacggtgcttgtacaaagtacgagtacccatggcacactgcaaagtgtcactatgaacgagattaccaatatgagacaagttggggctgtaatccatcagactgccccggggtgggtacaggctgtacagcatgtgggctttatcttgaccagttaaagccagttggcagtgcatataaaatcattacaataagatatagtagaagagtctgtgttcagtttggagaagaaaacctttgcaaaattatagacatgaatgactgctttgtatctagacatgttaaagtctgtatcattgggacagtttctaagttttcacaaggtgatacactactgtttttcgggccacttgaaggcggtggattgatatttaaacactggtgtacatctacatgtcagtttggtgacccaggagacatcatgagcccaagagacaaaggttttttatgccctgagttcccaggtagttttaggaaaaaatgtaattttgctactactcctatttgtgaatatgatggaaatatggtctcaggttacaaaaaagtgatggcaacaattgactctttccaatccttcaatacaagcactatgcattttactgatgagaggatagaatggaaagaccctgatggaatgttgagggaccatataaatattttagtaacaaaggatattgattttgataatcttggtgaaaacccctgtaaaattggcttgcagacatcttctattgaaggggcatggggttctggtgtaggctttacacttacatgcttggtatcattaacagagtgtcctacttttttaacctctattaaggcctgtgataaagctatttgttacggtgcagaaagtgtgacattaacaaggggacaaaatacagtgaaggtatcaggaaaaggcggtcacagtggttcaactttcaaatgttgccatggggaagactgctcaaagattgggctccatgctgctgcaccccaccttgataaagttaacgggatctctgaaatagaaaacagtaaagtatatgatgatggagcaccacaatgtggtataaaatgttggtttgtcaaatcaggggaatggatttcagggatatttagtggcaattggattgtgctcattgtcctctgtgtcttcttgctgttttcattggtcttactcagtatcctttgccctgtcaggaagcataagaaatcatag

SEQ ID NO: 3309 - RNA, 3408 nt, synthetic construct
  misc_feature 1..3408: note = derived and/or modified CDS sequence (wt) from HTNV(JS1)__KP970560.1__GP
  source 1..3408: mol_type = other RNA
atggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaatagcaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagcttgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctctcccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggagggaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 3310 - RNA, 3408 nt, synthetic construct
  misc_feature 1..3408: note = derived and/or modified CDS sequence (wt) from HTNV(LongquanAa-08-150)__JQ912803.1__GP
  source 1..3408: mol_type = other RNA
atggggatatggaagtggctagtaatggccagtttagtatggccagcttttacactgagaaatgtgtatgacatgaaaattgagtgcccccacacagttagctttggtgaaaacagcgtgataggttatgtggaattaccccctatgccattggctgacacagcacaaatggtgccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaatttgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgttagaaggtaaatgttttgttccagaccaaagtgtagtcagtatcatcaagcatgggatcttcgacatagcaagtgttcatattgtttgtttctttgtggcagttaaaggaaacacatacaaacttcttgaacaggtcaaaaagtcatttcaatccacatgcaatgatactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttatttggacagggatgattgacttacctggatactatgaggctatacatccttgtacagtcttttgtgtattatcaggccccggggcatcatgtgaagcattttctgaaggcggaattttcaacataacatcccctatgtgcttagtgtcaaagcaaaatcgattccggttaacagaacagcaagtaaactttgtttgtcaaagagttgatgtggacattattgtgtactgtaatggccagaggaaagtgatattgacaaaaaccttagtcataggacagtgcatatatactataacaagtttattctcactgctacctggggtagcacattccattgctgttgaattgtgtgtgcctggattccatggttgggctacagctgccctccttgttacattctgctttgggtgggttcttataccagcactaacactcattatcttaacaattttaaagtttattgcaaatatcttccacacatgtaatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttaaagaagactgttactcctcaaaactttacacctggttgctatcggacactgaacctgttcaggtataaaagtagatgttatatctttacaatgtgggtctgcctcctggtcttggagtcaatactatgggctgccagtgcttcagaagtgcccttaaatcctgtatggaatgataatgcccatggggtagggtctgtcccgatgcacactgacttagagctggacttttccctaacatcaagctcaaagtatacataccgcagaaggctgacaaatccacttgaagagacacaatcaattaaccttcacattgaaatagaagaacaaacaattggtgttgatgtgcatgcattgggccactggtttgatggtcggctcaaccttaaaacatctttccattgctatggcgcctgtacaaaatatgagtatccctggcacactgcaaagtgtcactatgaacgggattaccagtatgagacaagttggggctgtaacccagctgattgcccaggggtagggacaggttgcacagcatgtggattatatcttgatcaattgaagcctgttggtagtgcatataaaatcattacaataagatatagcaggaaagtgtgtgttcaatttggggaggaaaacctatgtaaggtaatagacatgaatgattgctttgttactagacacgttaaagtatgcataattggcacagtctctaaattttcccaaggtgatacactattgttcttcggaccacttgagggtggtgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgacggcaatatggtctcaggttataagaaggtaatggcaacaattgattcttttcaatcctttaatactagtactatgcactttactgatgagagaatagagtggaaagacccagatgggatgttaagggatcatataaacattctggtgactaaggacattgatttcgataacctcggtgaaaacccctgtaaaattggactacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagtcaaggtgtcaggtaaaggtggtcacagcggttcaactttcaaatgctgtcatggagaagaatgttcacagattggactccatgcggctgcacctcaccttgataaagtcaatgggatttcagaaattgagaataataaagtatatgatgatggggcaccccaatgtggggtaaagtgctggtttgtaaaatctggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3311 - RNA, 3408 nt, synthetic construct
  misc_feature 1..3408: note = derived and/or modified CDS sequence (wt) from HTNV(LongquanAa-08-157)__JQ912804.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattatcccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatctcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaaaactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctgatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3312 - RNA, 3408 nt, synthetic construct
  misc_feature 1..3408: note = derived and/or modified CDS sequence (wt) from HTNV(LongquanAa-08-196)__JQ912805.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtatatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatcttgctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggtcagtgcatatatacaataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggactacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaactttcaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3313 - RNA, 3408 nt, synthetic construct
  misc_feature 1..3408: note = derived and/or modified CDS sequence (wt) from HTNV(LongquanAa-08-235)__JQ912810.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtctttgagtcaatactgtgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtgtaaattggattgtactcattgttctttgtgtattcttgttgttttcactggtgttactcagtgtcctttgtcctgtaagaaagcacaaaaaatcataa

SEQ ID NO: 3314 - RNA, 3408 nt, synthetic construct
  misc_feature 1..3408: note = derived and/or modified CDS sequence (wt) from HTNV(LongquanAa-09-171)__JQ912824.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaaataatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctgatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtgagaaagcacaaaaaatcataa

SEQ ID NO: 3315 - RNA, 3408 nt, synthetic construct
  misc_feature 1..3408: note = derived and/or modified CDS sequence (wt) from HTNV(LongquanAa-09-191)__JQ912825.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccgtatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttagatcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaaaactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctgatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtgagaaagcacaaaaaatcataa

SEQ ID NO: 3316 - RNA, 3408 nt, synthetic construct
  misc_feature 1..3408: note = derived and/or modified CDS sequence (wt) from HTNV(LongquanAa-09-350)__JQ912835.1__GP
  source 1..3408: mol_type = other RNA
atggagatatggaagtggctagtaatggccagtttagtatggccagcttttacacggagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtatatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatcttgctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaaaaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3317 - RNA, 3408 nt, synthetic construct
  misc_feature 1..3408: note = derived and/or modified CDS sequence (wt) from HTNV(LongquanAa-09-489)__JQ912844.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccgtatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtctgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaaaactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttacagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtatgagacaagttggggctgtaacccagctgattgcccaggggtagggacaggttgcacagcatgtggattatatcttgatcaattgaagcctgttggtagtgcatataaaatcattacaataagatatagcaggaaagtgtgtgttcaatttggggaggaaaacctatgtaaggtaatagacatgaatgattgctttgttactagacacgttaaagtatgcataattggcacagtctctaaattttcccaaggtgatacactattgttcttcggaccacttgagggtggtgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcaggttataagaaggtaatggcaacaattgattcttttcaatcctttaatactagtactatgcactttactgatgagagaatagagtggaaagacccagatgggatgttaagggatcatataaacattctggtgactaaggacattgatttcgataacctcggtgaaaacccctgtaaaattggactacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagtcaaggtgtcaggtaaaggtggtcacagcggttcaactttcaaatgctgtcatggagaagaatgttcacagattggactccatgcggctgcacctcaccttgataaagtcaatgggatttcagaaattgagaataataaagtatatgatgatggggcaccccaatgtggggtaaagtgctggtttgtaaaatctggagaatggatctcagggatttttagtggaaactggattgtactcattgttctttgtgtattcttgttgttttcactggtgttactcagtgtcctttgtcctgtaagaaagcacaaaaaatcataa

SEQ ID NO: 3318 - RNA, 3408 nt, synthetic construct
  misc_feature 1..3408: note = derived and/or modified CDS sequence (wt) from HTNV(LongquanAa-09-541)__JQ912850.1__GP
  source 1..3408: mol_type = other RNA
atggggatatggaagtggctagtaatggccagtttagtatggccagcttttacactgagaaatgtgtatgacatgaaaattgagtgcccccacacagttagctttggtgaaaacagcgtgataggttatgtggaattaccccctatgccattggctgacacagcacaaatggtgccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaatttgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgttagaaggtaaatgttttgttccagaccaaagtgtagtcagtatcatcaagcatgggatcttcgacatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaggctatacatccttgtacagtcttttgtgtattatcaggccccggggcatcatgtgaagcattttctgaaggcggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctggattccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttaaagaagactgttactcctcaaaactttacacctggttgctatcggacactgaacctgttcaggtataaaagtagatgttatatctttacaatgtgggtctgcctcctggtcttggagtcaatactatgggctgccagtgcttcagaagtgcccttaaatcctgtatggaatgataatgcccatggggtagggtctgtcccgatgcacactgacttagagctggacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgctatggcgcctgtacaaaatatgagtatccctggcacactgcaaagtgtcactatgaacgggattaccagtatgagacaagttggggctgtaacccagctgattgcccaggggtagggacaggttgcacagcatgtggattatatcttgatcaattgaagcctgttggtagtgcatataaaatcattacaataagatatagcaggaaagtgtgtgttcaatttggggaggaaaacctatgtaaggtaatagacatgaatgattgctttgttactagacacgttaaagtatgcataattggcacagtctctaaattttcccaaggtgatacactattgttcttcggaccacttgagggtggtgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgacggcaatatggtctcaggttataagaaggtaatggcaacaattgattcttttcaatcctttaatactagtactatgcactttactgatgagagaatagagtggaaagacccagatgggatgttaagggatcatataaacattctggtgactaaggacattgatttcgataacctcggtgaaaacccctgtaaaattggactacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagtcaaggtgtcaggtaaaggtggtcacagcggttcaactttcaaatgctgtcatggagaagaatgttcacagattggactccatgcggctgcacctcaccttgataaagtcaatgggatttcagaaattgagaataataaagtatatgatgatggggcaccccaatgtggggtaaagtgctggtttgtaaaatctggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3319 - RNA, 3408 nt, synthetic construct
  misc_feature 1..3408: note = derived and/or modified CDS sequence (wt) from HTNV(LongquanAa-09-698)__JQ912854.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtattctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggattctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaattcggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagatccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaactttcaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3320 - RNA, 3408 nt, synthetic construct
  misc_feature 1..3408: note = derived and/or modified CDS sequence (wt) from HTNV(LongquanAa-10-393)__JQ912859.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtatatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggagggttcttataccagcacttacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3321 - RNA, 3408 nt, synthetic construct
  misc_feature 1..3408: note = derived and/or modified CDS sequence (wt) from HTNV(LongquanAa-10-58)__JQ912861.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtatatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtttattcttgttgttttcactggtgttactcagtgtcctttgtcctgtaagaaagcacaaaaaatcataa

SEQ ID NO: 3322 - RNA, 3408 nt, synthetic construct
  misc_feature 1..3408: note = derived and/or modified CDS sequence (wt) from HTNV(LongquanAa-10-74)__JQ912864.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtatatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaaaactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttgaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3323 - RNA, 3408 nt, synthetic construct
  misc_feature 1..3408: note = derived and/or modified CDS sequence (wt) from HTNV(LongquanAa-10-98)__JQ912866.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacttgtgttctaaagcacaagatgttagaagaatcataccgcagcagaaaatcaatcacttgttatgacctttcctgcaatagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgtcccagaccaaagtgtagtcagcatcatcaagcatgggatcttcgatatagcaagtgttcatattgtttgtttctttgtggcagttaaaggaaacacatacaaacttcttgaacaggtcaaaaagtcatttcaatccacatgcaatgatactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaggctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggctgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcacactgacttagagcttgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtatgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgagagaatagagtggaaagacccagatgggatgttaagggatcatataaacattttggtgactaaggacattgattttgataacctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatctgttatggtgcagaaagtgtaacattaacaagaggtcagaacacagttaaggtgtcaggtaaaggtggtcacagcggttcaactttcaaatgctgtcatggagaagaatgttcacaaatcggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctctgtgtattcttgttgttttcactggtattactcagtgtcctttgtcctgtaagaaagcacaaaaaatcataa

SEQ ID NO: 3324 - RNA, 3408 nt, synthetic construct
  misc_feature 1..3408: note = derived and/or modified CDS sequence (wt) from HTNV(LongquanAa-11-452)__KC344264.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaataaatacaataacaaaatacacccaggtaagttggagaggtaaggctgatcaggcacaagccagccagaattcatttgaagcagtgtctgctgaagttgatcttaaaggaacttgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactcgggccttacagagtgcaagtagtttatgaaagaacctactgtatgaccggggtcctgatagaaggaaaatgttttgttccagaccaaagtgtagtcagcattattaagcatgggattttcgatatagcaagtgttcatattgtttgtttctttgtggcagttaaaggaaacacatacaaacttcttgaacaggtcaaaaagtcatttcaatccacatgcaatgatactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattattggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacggggatgattgacttacctggatactatgaggctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcacactgacttagagcttgacttttccctaacatcaagctcaaagtatacataccgcagaaggctgacaaatccacttgaagaaacacaatcaatcaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtatgagacaagttggggctgtaacccagctgattgcccaggggtagggacaggttgcacagcatgtggattatatcttgatcaattgaaacctgttggtagtgcatataaaatcattacaataagatatagcaggaaagtgtgtgttcaatttggggaagaaaacctatgtaaggtaatagacatgaatgattgctttgtcactagacacgttaaagtatgcataattggcacagtctctaaattttcccaaggtgatacattattgttcttcggaccacttgagggtggtgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgagagaatagagtggaaagacccagatgggatgttaagagatcatataaacattctggtgactaaggacattgattttgataacctcggtgaaaacccctgtaaaattggattacagacatcctcaattgaaggggcctggggttctggtgtaggctttacactcacatgtctaatatctttaacagagtgtcccacgttcctgacctcgattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3325 - RNA, 3408 nt, synthetic construct
  misc_feature 1..3408: note = derived and/or modified CDS sequence (wt) from HTNV(LongquanAa-11-473)__KC344263.1__GP
  source 1..3408: mol_type = other RNA
atggggatatggaagtggctagtaatggccagtttagtatggccagcttttacactgagaaatgtgtatgacatgaaaattgagtgtccccacacagttagctttggtgaaaacagcgtgataggttatgtggaattaccccctatgccattggctgacacagcacaaatggtgccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaatttgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgttagaaggtaaatgttttgttccagaccaaagtgtagtcagtatcatcaagcatgggatcttcgacatagcaagtgttcatattgtttgtttctttgtggcagttaaaggaaacacatacaaactttttgaacaggtcaaaaagtcatttcaatccacatgcaatgatactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaaactcaacagaagctaagcatgtatttagccctggcttctttccacagcttaaccatacaaagtgtgataaaactgccatcccacttatttggacagggatgattgacttacctggatactatgaggctatacatccttgtacagtcttttgtgtattatcaggccccggggcatcatgtgaagcattttctgaaggcggaattttcaacataacatcccctatgtgcttagtgtcaaagcaaaatcgattccggttaacagaacagcaaataaactttgtttgtcaaagagttgatgtggacattattgtgtactgtaatggccagaggaaagtgatattgacaaaaactttagtcataggacagtgcatatatactataacaagtttattctcactgctacctggggtagcacattccattgctgttgaattgtgtgtgcctggattccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttaaagaagactgttactcctcaaaactttacacctggttgctatcggacactgaacctgttcaggtataaaagtagatgttatatctttacaatgtgggtctgcctcctggtcttggagtcaatactatgggctgccagtgcttcagaagtgcccttaaatcctgtatggaatgataatgcccatggggtagggtctgtcccgatgcacactgacttagagctggacttttccctaacatcaagctcaaagtatacataccgcagaaggctgacaaatccacttgaagagacacaatcaattaaccttcacattgaaatagaagaacaaacaattggtgttgatgtgcatgcattgggccactggtttgatggtcggctcaaccttaaaacatctttccattgctatggcgcctgtacaaaatatgagtatccctggcacactgcaaagtgtcactatgaacgggattaccagtatgagacaagttggggctgtaacccagctgattgcccaggggtagggacaggttgcacagcatgtggattatatcttgatcaattgaagcctgttggtagtgcatataaaatcattacaataagatatagcaggaaagtgtgtgttcaatttggggaggaaaacctatgtaaggtaatagacatgaatgattgctttgttactagacacgttaaagtatgcataatcggcacagtctctaaattttcccaaggtgatacactattgttctttggaccacttgagggtggtgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgacggcaatatggtctcaggttataagaaggtaatggcaacaattgattcttttcaatcctttaatactagtactatgcactttactgatgagagaatagagtggaaagacccagatgggatgttaagggatcatataaacattctggtgactaaggacattgatttcgataacctcggtgaaaacccctgtaaaattggactacagacatcctcaattgaaggggcctggggttctggtgtaggctttacactcacatgtctaatatctttaacagagtgtcccacgttcctgacctcaattaaggcttgtgataaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtgagaaagcacaaaaaatcataa

SEQ ID NO: 3326 - RNA, 3408 nt, synthetic construct
  misc_feature 1..3408: note = derived and/or modified CDS sequence (wt) from HTNV(LongquanAa-11-642)__KC344262.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacttgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgttagaaggtaaatgttttgttccagaccaaagtgtagtcagtatcatcaagcatgggatcttcgacatagcaagtgttcatattgtttgtttctttgtggcagttaaaggaaacacatacaaactttttgaacaggtcaaaaagtcatttcaatccacatgcaatgatactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttatttggacagggatgattgacttacctggatactatgaggctatacatccttgtacagtcttttgtgtattatcaggccccggggcatcatgtgaagcattttctgaaggcggaattttcaacataacatcccctatgtgcttagtgtcaaagcaaaatcgattccggttaacagaacagcaagtaaactttgtttgtcaaagagttgatgtggacattattgtgtactgtaatggccagaggaaagtgatattgacaaaaactttagtcataggacagtgcatatatactataacaagtttattctcactgctacctggggtagcacattccattgctgttgaattgtgtgtgcctgggttccatggttgggctacagctgccctccttgttacattctgttttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccctaaatcctgtatggaatgataatgcccatggggtagggtctgtaccgatgcacactgacttagagcttgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaaatgtcactatgaacgggattaccagtatgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgtataattggcacagtctctaaattttcccaaggtgatacattattgttcttcggaccacttgagggtggtgggttgatatttaaacactggtgcacatccacatgccagtttggagaccctggagatatcatgagtcccagggataagggatttttatgccctgaatttcctggaagctttaggaagaagtgtaattttgccactactcctctttgtgagtatgatggcaatatggtctcagggtataagaaggtaatggcaacaattgattcttttcaatcctttaacactagtactatgcactttactgatgagagaatagagtggaaagacccagatgggatgttaagggatcatataaacattctggtgactaaggacattgattttgataacctcggtgaaaacccctgtaaaattggattacagacatcctcaattgaaggggcctggggttctggtgtaggctttacactcacatgtctaatatctttaacagagtgtcccacgttcctgacctcgattaaggcttgtgacaaagccatttgttatggtgcagaaagtgtaacattaacaagaggtcagaacacagttaaggtgtcaggtaaaggtggtcacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3327 - RNA, 3408 nt, synthetic construct
  misc_feature 1..3408: note = derived and/or modified CDS sequence (wt) from HTNV(LongquanAa-11-774)__KC344257.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagtgaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaacttttaaatgctgtcatggagaaaaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3328 - RNA, 3408 nt, synthetic construct
  misc_feature 1..3408: note = derived and/or modified CDS sequence (wt) from HTNV(LongquanMf-09-8)__JQ912875.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatatgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgacttttccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagcctgttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtaaataaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggtcacagcggttcaactttcaaatgctgtcatggagaagaatgttcacaaattggactccatgctgctgcacctcaccttgacaaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3329 - RNA, 3408 nt, synthetic construct
  misc_feature 1..3408: note = derived and/or modified CDS sequence (wt) from HTNV(ROKA14-11)__KU207203.1__GP
  source 1..3408: mol_type = other RNA
atggggatatggaagtggctagtgatggctagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagttagttggagaggaaaggctgatcagtcacagtctagccaaaattcatttgagacagtgtctactgaagttgacttgaaaggaacatgtgttctgaaacacaagatggtagaagaatcttaccgcagtagaaaatcaataacctgttatgacctatcatgcaatagcacttattgcaagccaacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggtcagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtacaggggtattatatctgtattgtggggggaaactctgcaccaatatatgttccaacacttgatgacttcagatccatggaagcattcacaggaatctttagatcaccacatggagaagaccatgatctagctggagaagaaactgcgacttactctatagttggacctgccaatgcaaaagttcctcacagtgctagctcagacacattgagcctgattgccttctcaggtataccatcttattcttcccttagcatcctaacaagttcaacagaagccaaacatgtattcagccctgggttgttcccaaagcttaatcacacaaattgtgataaaggtgccataccactcatgtggactgggatgattgatttacctggatattatgaggctatccacccctgtacagtattttgtgtattatcaggtcctggggcatcatgtgaggccttttctgaaggcgggattttcaacataacctcccccatgtgcttagtgtcaaagcaaaatcgattccggttgacagaacagcaagtgaattttgtatgtcagcgagtggacgtggacatcgttgtgtactgcaatgggcagagaaaagtaatattgacaaaaactttagttattggacaatgtatatacactataacaagtttattttcattactgcctggggtagcacactctattgctgttgaattgtgtgtacctggattccatggttgggccacagctgctctgcttgttacattctgttttgggtgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcgatggtatgtgatgtctgcaagtatgagtgtgaaacctataaagagttgaaggcacatggtgtatcatgcccccagtctcaatgcccttattgctttactcattgtgaacccacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggacgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatccacatgtcaatttggtgacccaggagacatcatgagcccaagagacaaaggttttttatgccctgagttcccaggtagtttcaggaagaaatgcaactttgctactactcccatttgtgagtatgacggaaatatggtctcaggttacaagaaagtaatggcaacaattgattcctttcaatcttttaatacaagcactatgcactttactgatgaaaggatagagtggaaagaccctgatggaatgctaagggatcatataaacatcttagtaacaaaagacatcgactttgataaccttggtgaaaatccttgcaaaattggcctacaaacatcttccattgagggggcatggggttctggtgtagggtttacatccacatgtctggtatcactgacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaagactgttcgcaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtgaggaagcataaaaagtcatag

SEQ ID NO: 3330 - RNA, 3408 nt, synthetic construct
  misc_feature 1..3408: note = derived and/or modified CDS sequence (wt) from HTNV(US8A15-1)__KU207205.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacacaagatggtagaagaatcataccgcagtagaaaatcaataacctgttatgacctatcatgcaatagcacttattgcaagccgacactatacatgattgtaccaattcatgcatgcaatatgatgaaaagctgtttgattgccttgggaccatacagagtacaagtagtttatgagagaacctattgcatgacaggagtcctaattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcatttgaatcaacatgcaatgatacagagaataaagtgcaggggtactatatctgtattgtggggggaaactctgcaccaatttatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcctcccttagcatcctgacaagttcaacagaagccaaacatgtattcagccctgggttgttcccaaaacttaatcacacaaattgtgataaaggtgccataccactcatgtggactgggatgattgatttacctggatactatgaggctatccatccctgtacagtattttgtgtattatcaggtcctggggcatcatgtgaggccttttctgaaggcgggattttcaacataacctcccccatgtgcttagtatcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaaattcattgctaatattttccacacaagtaaccaagagaacaggttaaaatcagtacttagaaagataaaggaagagtttgaaaaaacaaaaggctcaatggtatgtgatgtctgcaagtatgagtgtgaaacctataaagagttgaaggcacatggtgtgtcatgcccccagtctcaatgcccttattgctttactcattgtgaacccacagaagcagcattccaggcccattacaaagtatgccaagttactcataggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtctcaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggcggtctaatatttaaacactggtgcacatccacatgtcaatttggcgacccaggagacatcatgagcccaagagacaaaggatttttatgccctgagttcccaggtagtttcaggaagcactgcaactttgctactactcctatttgtgagtatgacggaaatatggtctcaggttacaagaaagtaatggcaacaattgattcctttcaatcttttaatacaagcactatgcactttactgatgaaagaatagagtggaaagaccctgatggaatgctgagggatcatataaacatcttagtaacaaaagacatcgactttgataaccttggtgaaaatccttgcaaaattggcctacagacatcttccattgagggggcctggggttctggtgtagggtttacattaacatgtctggtatcgctaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggactgttcgcaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcactgttctctgcgtatttctattgttctcattggttttactgagcattctctgtcccgtgaggaagcataaaaagtcatag

SEQ ID NO: 3331 - RNA, 3408 nt, synthetic construct
  misc_feature 1..3408: note = derived and/or modified CDS sequence (wt) from HTNV(Lee)__D00377.1__GP
  source 1..3408: mol_type = other RNA
atggggatatggaagtggctagtgatggccagtttagtatggcctgttttgacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaacttcatttgagacagtgtctactgaagttgacttgaaaggaacatgtgttctgaaacacaagatggtagaagaatcttaccgcagtagaaaatcaataacctgttatgacctatcatgcaatagtacttattgcaagcctacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggttagtattatcaagcatgggatttttgatatcgcaagtgttcatattgtgtgcttctttgtcgcagttaaagggaatacttataaaatttttgaacaggttaagaaatcctttgaatcaacatgcaatgatacagagaataaagtgcaagggtattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatctgattcttcccttagcatcctgacaagttcaacagaagccaaacatgtattcagccctgggttgttcccaaaacttaatcacacaaactgtgataaaggtgccataccactcatgtggactgggatgattgatttacctggatactatgaggctatccacccctgtacagtattttgtgtattatcaggtcctggggcatcatgtgaggccttttctgaaggcgggattttcaacataacctaccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggagtagcacactctattgctgttgaactgtgtgtacctggattccatggttgggccacagctgctctgcttgttacattctgttttggatgggttcttataccagcaatcacatttatcatactgacaatcctaaagttcattgctaatattttccacacaagtaaccaagagaacaggctaaaatcagtacttagaaagataaaggaagagtttgaaaaaacaaaaggctcaatggtatgtgatgtctgcaagtatgagtgtgaaacctataaagagttgaaggcacacggggtgtcatgcccccagtctcaatgcccttattgctttactcattgtgaacccacagaagcagcattccaagcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttctagtcttagaatctatactgtgggctgcaagtgcatcagagacaccattgactcctgtttggaatgacaatgcccatggagtaggttctgttcctatgcacacagatttagaacttgatttctctttaacatctagttccaagtatacataccgtaggaagctaacaaacccacttgaagaagcacaatccattgatctacatattgaaatagaagaacaaacaattggtgtagatgtgcatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactaaaaccagttggcagtgcttataaaatcatcacaataaggtatagcaggagggtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatccacatgtcaatttggcgacccaggagacatcatgagcccaagagacaaaggctttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctacaaacatcttccattgagggggcctggggttctggtgtagggtttacattaacatgtctggtatcgctaacagaatgtcctacctttttgacctcaataaaggcttgtgataaggctatctgttatggtgcagagagtgtaacattaacaagagggcaaaatacagtcaaggtatcaggaaaaggtggccatagtggttcaacatttaagtgttgccatggggaggactgttcacaaattggactccatgctgctgcacctcacctagacaaggtcaatgggatttctgagatggaaaatagcaaagaatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3332 - RNA, 3384 nt, synthetic construct
  misc_feature 1..3384: note = derived and/or modified CDS sequence (wt) from HTNV(M)__U38177.1__GP
  source 1..3384: mol_type = other RNA
atggccagtttagtatggcctgttttgacactgagaaatgtctatgacatgaaaattgagtgcccccatacagtaagttttggggaaaacagtgtgataggttatgtagaattaccccccgtgccattggccgacacagcacagatggtgcctgagagttcttgtaacatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaagttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggagctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctctcccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacagtgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaatcaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 3333 - RNA, 3408 nt, synthetic construct
  misc_feature 1..3408: note = derived and/or modified CDS sequence (wt) from HTNV(N8)__EF077656.1__GP
  source 1..3408: mol_type = other RNA
atggggatatggaagtggctagtaatggccagtttagtatggccagcttatacactaagaaatgtgtatgacatgaaaattgagtgcccccacacagtcagctttggtgaaaacagcgtgatagggtatgtggaattaccccctatgccactggctgatacagcacaaatggtgcctgaaagctcttgtaacatggacaaccaccaatcaatgaatacaataacaaaatatacccaggtaagctggaggggtaaggctgatcaggcacaagccagtcagaattcatttgaagcagtgtctgctgaggttgaccttaaaggaacttgtgttttgaagcacaaaatgctagaagaatcataccgcagcagaaaatcaataacatgttatgacctttcctgcaacaatacctactgtaagcccactctgtatatgattgtaccaattcatgcatgtaacatgatgaaaagttgcttaattgcactagggccttatagagtacaagtaatttatgaaagaacctactgcatgacaggggtcctgatagaaggaaaatgttttgttccagaccaaagtgtagttagtatcatcaagcatgggatctttgatatagcaagtgttcatattgtttgtttctttgtggcagttaaaggaaacacatataaactttttgaacaggtcaagaagtcgtttcaatcgacatgcaatgatactgaaaataaagtacaaggatattatatctgcatcgtgggagggaactctgcacctatatatgtgccaacacttgatgatttcaggtccatggaggcattttcagggatttttagatcaccacacggagaggaccatgatctagctggagaagagattgcttcttactctattgttggacctgctaatgcaaaagtgccccacagtgctagctcagacacattaagcctgattgcctattctggtatcccatcctactcttcacttagcatccttacaggctcaacagaagctaagcatgtatttagccccggtttctttccacagcttaaccatacaaagtgtgataagactgccatcccacttacgtggacagggatgattgacttgccaggatactatgaggctatacacccttgtacagttttttgtgttctatcaggccccggggcatcatgtgaagcattctctgaaggtggaatcttcaacataacatcccctatgtgcttagtatcaaaacaaaatcgattccggttaacagaacagcaagtaaacttcgtatgtcaaagggttgatatggatattattgtatattgcaatggccagaggaaagtaatacttacaaaaaccttagtcataggacagtgtatatatactataacaagtttattctcactgctacctggggtggcacattccattgctgttgaactttgtgtgcctgggttccatggctgggctacagctgccctccttgtcacattctgcttcgggtgggtcctcataccagcaataacattcattatcctgacagttttaaagtttattgcaaatatctttcatacaagtaaccaagagaataggcttagagcagtattaagaaaaataaaggaagaattcgagaagacaaaagggtcaatggtgtgtgatgtctgtaagtatgagtgtgaaacttataaagaattgaaggcacatggggtttcatgccctcagtcccaatgtccatactgcttcactcattgtgaacctacagaagcagcattccaggctcattatagagtatgtcaagtcacccacagattcagggatgacttaaagaagacggtcactcctcaaaattttacacctggctgctataggacactaaacctgtttagatataaaagtagatgttatatctttacaatgtgggtctgcctcctagtcctagagtcaatactttgggctgccagtgcttcagaagtaccattaaatcctgtatggaacgataatgcccatggggtaggatcagtaccgatgcacacagacttagagctggacttttccctaacatcaagttcaaagtatacatatcgcagaaggctaacaaatccacttgaagaaacacaagcaattaaccttcatattgaaatagaagaacaaacaattggtgttgatgtgcatgccttgggtcattggtttgacggtcggctaaaccttaaaacatctttccattgttacggtgcctgcacaaaatatgagtatccttggcacactgcaaaatgtcactatgaacgggattaccagtatgagacaagttggggctgcaacccagctgattgtccaggggtgggaacaggttgtacagcatgtggactatatattgatcagttaaagcctgttggtagtgcatataaaattattacaatcagatatagcaggaaagtgtgtgttcagtttggggaggaaaatctatgtaaggtgatcgacatgaatgattgctttgtctctagacatgtcaaagtatgtataatcggcacagtctccaaattctcccaaggtgatacactattattctttggaccacttgagggcggtggtttaatatttaaacattggtgcacatctacatgtcagtttggagaccctggagatattatgagtccaagggataagggatttttatgccctgaatttcctgggagttttaggaagaaatgtaattttgctactacccctctttgtgagtatgatggtaatatggtttcaggttacaagaaagtaatggcaacaattgattctttccaatcctttaataccagtactatgcacttcactgatgagagaatagagtggaaagaccctgatggaatgttaagggaccatataaacattctggtaactaaggacatcgactttgataacctgggtgaaaacccttgtaagattggcttacaaacatcttcaattgaaggggcttggggttctggtgtaggctttacacttacatgtctagtatctttaacagagtgtcctactttcttaacctcgattaaggcttgtgacaaagccatttgttatggtgcagaaagtgtggcgttaacaagaggccagaacacagttaaggtgtcaggcaaaggtggtcatagcggttcaacttttaaatgctgccatggagaagagtgttcacaaattggactccatgctgctgcaccccaccttgataaagtcaatgggatttcagaagtcgagaacaataaagtatatgatgatggggcaccccaatgtggggtaaagtgctggtttgtaaaatctggagaatggatctcagggatctttagtggaaattggattgtgcttattgtcctttgtgtattcttactgttttcactggtgttactcagtgtcctttgtcccgtaagaaagcataagaagtcatag

SEQ ID NO: 3334 - RNA, 3408 nt, synthetic construct
  misc_feature 1..3408: note = derived and/or modified CDS sequence (wt) from HTNV(Q32)__DQ371905.1__GP
  source 1..3408: mol_type = other RNA
atggggatatggaagtggctagtaatggccagtttagtctggccagcctttgcactaaggaatgtgtatgacatgaaaattgagtgtccccacacagttagttttggagagaacagtgttataggatatgttgaactgcctcctatgccactggctgacacaacgcaaatggtgccggaaagctcttgcagcatggataatcaccaatcattaaacacaatcacaaaatacacccaaataatctggagaggaaaggctgatcaatcccaatccagccaaaattcatttgagacagtgtctactgaggttgaccttaaaggaacctgtgtattaaaacacaagatgatagaagaatcataccgcagtcggaagtcaataacttgttatgatctgtcctgcaacagcacctattgcaaaccaactctgtacatgatcgtaccaatccatgcatgtaatatgatgaagagctgtttaattgcactaggaccttatagggtccaggttgtttatgaaagaacctattgcatgacaggggttttaattgaagggaaatgctttgttcctgaccagagtgtagttagtatcattaaacatgggatcttcgatattgcaagtgtccacattgtttgcttttttgttgcagtcaaaggaaacacatacaagatctttgaacaggttaaaaagtcatttgaatctaattgtaatgacactgaaaataaagtgcaagggtactacatttgtattatagggggaaattcctcacccgtatatgtaccaacactggatgattttaggtcaatggaagcattctcaggaatttttagatcaccacatggagaagaccatgatctagctggagaagaggttgcatcatattctattgttggacctgctaatgctaaggtgccccatagtgccagctcagacacattaggcttaattgcttattttggtataccatcttattcttctctcagcatcctcacaagctcaacagaagcaaagcatgtgttcagccctggattattcccccagctaaaccatacaaagtgtgacaaaactgctataccattgacatggacagggatgattgaccttcctggatactatgaagctatacatccttgcacagttttctgtgtcttgtcaggtcccggggcttcatgtgaggctttttctgaaggtggaatcttcaatataacttctccaatgtgtctagtgtcaaagcagaatcgttttagactaacagaacaacaggtgaattttgtatgccagagggttgatgttgacattattgtttattgtaatggtcagagaaaagtaatattaacaaagactctggttattgggcaatgtatatatactataacgagcctattctcactattacctggggtagcacattcaattgcagttgaactgtgtgttcctgggttccatgggtgggccacagctgcattacttgttacattttgctttggttgggttctcatcccagcaatcacattcattatattgacaattttaaagttcattgcaaatatcttccacacaagcaatcaggagaataggctaaagtcagtactcagaaagataaaggaagaatttgaaaggacaaagggatcaatggtgtgtgatatatgtaaatatgagtgtgagacttataaagaactaaaggcacatggggtctcatgcccacaatcccaatgcccttattgtttcacccactgtgagcccacagaagctgcatttcaggcccattataaagtgtgtcaagttactcatagatttagggatgatttaaagaagacagttactccccagaacttcacacctggttgctatcgaacattgaatttattcagatataagagtaggtgttatatttttacaatgtgggtttttcttttagtcttagaatcaatcttatgggcagccagtgcatcagaaatacctttaaatccagtatggaacgacaatgcccatggggttgggtccatacccatgcacacagatttagagctagacttttccttgacatcaagctcaaagtacacctaccgaaggaaactaacaaacccacttgaagaatctcaggcaattgacctccatgtagaaatagaagagcaaacaattggtgtagatgtgcatgcattgggtcattggtttgatggccgccttaatcttaagacatcctttcactgttacggtgcatgcaccaagtatgagtacccatggcatactgcaaaatgccactatgaaagggattaccaatatgagacaagttggggttgtaacccttcagactgtcctggtgtaggtacaggctgtactgcatgtgggttatatcttgatcagttgaaacctgttggaagtgcttacaaaatcattacaatacgatatagcagaagagtttgtgttcaatttggagaggaaaatctctgtaaaattatagatatgaatgattgctttgtttctaggcatgttaaagtctgtataatcggcacagtttctaaattttctcaaggtgatacactcctattctttggaccacttgaaggtggtggtctaatatttaaacattggtgcacatcaacatgccagtttggggacccaggagatattatgagtccaagagataagggatttttatgccctgagttcccaggtagctttagaaagaagtgtaattttgccacaacccctgtttgtgaatatgatgggaatatggtttcaggttataaaaaagtaatggccacaattgattcttttcaatccttcaatacaagcactatgcatttcactgatgagaggatagaatggaaagaccctgatgggatgttaagggaccatattaacattctggttacaaaggatattgactttgataatcttggtgaaaatccctgcaagattggattacaaacatcctccattgaaggggcatgggggtctggtgtaggctttacacttacatgtttgatatcactgacagaatgctctacattcttgacctcaatcaaagcttgtgacaaggcaatctgttatggtgcagagagtgtgacacttataagaggtcaaaatacagtgaaagtgtcaggaaagggcggacatagcggctcatccttcaaatgctgtcatggggaagaatgctcacagataggactccatgctgctgcacctcatcttgacaaggttaacgggatttcagagatggagaacagtaaagtgtttgatgatggggcaccacagtgtgggataaaatgctggtttgttaaatcaggggaatggatttctgggattttcagcggtaattggattgtacttattgttctatgtgtatttctactattctcattggtattgcttagtattctctgtcctgtcagaaagcataaaaagtcatag

SEQ ID NO: 3335 - RNA, 3408 nt, synthetic construct
  misc_feature 1..3408: note = derived and/or modified CDS sequence (wt) from HTNV(Bao14)__AB127995.1__GP
  source 1..3408: mol_type = other RNA
atggggatgtggaagtggctagtaatagccagtttagtatggcctgctttggcactgagaaatgtgtatgacatgaaaattgaatgcccccacacagtaagtttcggagaaaacagtgtaatagggtatgtggagttacctcctatgccattggctgacacagcacagatggtgcctgagagttcttgcagcatggataatcatcagtcaataaatactataacaaaatacactcaggtaatctggagagggaaggcggatccgggacaatccagtcagaattcatttgaaacagtgtctactgaagttgacttgaaaggaacatgtgttttaaagcataaaatggtggaagaatcataccgcagtcggaagtcaataacctgttacgacctttcttgcaatagtacttattgcaagccaacattatatatgattgtaccgatccatgcatgtaatatgatgaagagctgtctaattgcattagggccatacagagtgcaggtagtatatgagaggacctactgtatgacaggagtcttgattgaaggaaaatgttttgtcccagatcaaagtgttgttagcattattaagcatggaatctttgatattgcaagtgttcatattgtatgtttctttgttgcagttaagggaaacacctataagctctttgaacaggttaagaaatcatttgagtcaacttgcaatgacactgagaataaagtacagggttattacatctgtattgtgggaggaaattctgcaccgatctatgtccctacacttgatgatttcaggtccatggaagcatttacaggaatctttaaatcaccacatggagaagaccatgaccttgctggggaggagattgcttcatactctatagttggacctgcaaatgcaaaagtccctcatagtgcaagctcagacacactgagtctaattgcttattcaggtataccatcttattcttccctgagtatcttgacaagttcaacagatgctaagcatgtgtttagccctgggttgttcccaaagcttaaccatacaaactgtgataagagtgccataccgctcacatggactgggatgattgatttacctggatactatgaggccatacacccttgcacagttttttgtgtactgtcaggccctggggcatcatgtgaagcattttctgaaggtggaattttcaacataacttcccccatgtgcttagtttcaaagcaaaatcggttccggctaacagagcagcaggtaaactttgtgtgtcagagagtagacatggacattgttgtgtactgcaacggacagcggaaagtaatattaacaaaaactttagttattgggcaatgtatatatactataacaagcttgttttcactactacctggggtagcacattctattgctgtggaattatgtgtgcctggattccatggctgggccacagctgctttacttgttacattctgttttggatgggtccttataccagctgtcacatttattatactaacagtcttaaagtttattgctaacatttttcacacaagcaaccaagagaataggttgaaatcagtattgagaaaaataaaggaggagtttgaaaagacaaagggttcaatggtatgtgatgtttgcaagtatgaatgtgaaacctataaagaattaaaggcacatggggtatcttgtccccaatctcaatgcccttactgttttactcattgtgagcctacagaggcagcatttcaagcccactataaagtatgccaggtcacccataggttcagggatgatcttaaaaagactgtcactcctcagaatttcacaccaggttgttatcggacattaaatttatttagatacaaaagtagatgttacatttttacaatgtgggtattccttctcattctagaatctgtactgtgggctgctagtgcatcagaaacaccgttaactcctgtttggaatgacaatgcccatggtgttggttctgtgcctatgcacacagatctggagcttgatttttctctgacatcaagttctaagtatacataccgcaggaagctaacaaacccactggaagaggcacaatcaattgatctccatattgaaatagaagagcaaacaatcggtgttgatgtgcatgctctaggacattggtttgatggccgtcttaaccttaaaacatccttccattgttatggtgcctgtacaaagtatgagtacccatggcatactgcaaagtgtcactatgaacgagattaccaatatgagacaagttggggctgtaatccatcagactgccctggggtgggtacaggctgtacagcatgtgggctttatcttgaccagttaaagccagtgggcagtgcatataaaatcattacaataagatatagtagaagagtttgtgttcagtttggagaagaaaacctttgcaaaattatagacatgaatgattgctttgtatctagacatgttaaagtctgtatcattgggacagtttctaagttttcacaaggtgatacactattgtttttcgggccacttgaaggcggtggattgatatttaaacactggtgtacatctacatgtcagtttggtgacccaggagacatcatgagcccaagagacaaaggttttttatgccctgagttcccaggtagttttaggaaaaaatgtaattttgctactactcctatttgtgagtatgatggaaatatggtctcaggttacaaaaaagtgatggcaacaattgactctttccagtccttcaatacaagcactatgcactttactgatgagaggatagaatggaaagaccctgatggaatgttgagggaccatataaatattttagtaacaaaggatattgactttgataatcttggtgaaaacccctgtaaaattggcttgcagacatcctctattgaaggggcatggggttctggtgtaggctttacacttacatgcttggtatcattaacagagtgtcctacttttttaacctccattaaggcctgtgacaaagctatttgttatggtgcagaaagtgtgacattaacaagaggacaaaatacagtgagggtatcaggaaaaggtggtcatagtggttcaactttcaaatgttgccatggggaagactgttcaaaaattgggctccatgctgctgcaccccaccttgataaagttaatgggatctctgaaatagaaaacagtaaagtatatgatgacggagcaccacaatgtggtataaaatgttggtttgtcaagtcaggggaatggatttcagggatatttagtggcaattggattgtgctcattgtcctctgtgtattcttactgttttcattggtcttactcagtatcctttgccctgtcaggaagcataagaaatcatag

SEQ ID NO: 3336 - RNA, 3408 nt, synthetic construct
  misc_feature 1..3408: note = derived and/or modified CDS sequence (wt) from HTNV(HubeiHu02)__JQ665881.1__GP
  source 1..3408: mol_type = other RNA
atggggatatggaagtggctagtaatggccagtttagtctggccagcctttgcactaagaaacgtttatgacatgaaaattgagtgcccccacacagtcagttttggagaaaacagtgttataggttatgtcgaattgcctcctatgccactggctgacacagcacaaatggtgccagaaagctcctgcagcatggataatcaccaatcattaaatacaatcacaaaatatactcaaatagtatggagaggaaaagctgaccagtcacagtccagccagaactcgtttgagacagtgtctactgaggttgatcttaaaggaacctgtgtgttaaaacacaaaatggttgaagaatcataccgcagtcggaagtcaataacttgttatgatctatcttgcaatagtacctactgcaagccaacactttacatgattgtcccaatccatgcatgtaatatgatgaaaagttgtttaattgcactagggccttatagggtccaggttgtttatgaaagaacctactgcatgacaggagttttaattgaggggaaatgttttgttcctgaccagagtgttgtcagtatcatcaagcatgggatttttgatattgcaagcgttcacattgtttgtttctttgttgcggttaaaggaagtacatataaactttttgaacaggttaaaaaatcatttgaatctaactgtaatgatactgagaacaaggtgcagggacattacatatgcattgttgggggaaattcagcacccatatatgtaccaacactggatgactttaggtcgatggaagcattctcagggatttttaagtcaccacatggggaagaccatgatctagctggggaagaggttgcatcatattctattgttggacctgctaatgcaaaggtgccccacagtgccagttcagacacactgagcttaattgcctattctggtataccatcttattcttctcttagcatcctcacaagcttaacagaagcaaagcatgtattcagccctggattatttcctcagcttaaccatacaaagtgtgacaaaactgccataccattgacatggacaggaatgattgaccttcccggatactatgaagctgtacatccttgcacagttttctgtgtcctatcaggtcctggagcttcttgtgaggcattctctgaagggggaatccttaacataacttctccaatgtgtctagtgtcaaagcagaatcgctttagattaactgaacagcaggtaaactttgtatgccaaagagttgatgttgacattgttgtgtattgcaatggtcagagaaaagtaatcttaacaaagactttagttattgggcaatgtatatacactataacaagcttattttcactactacctggggttgcacattcaattgcagttgaattgtgtgttcctggattccatgggtgggctacagctgcactacttgtcacattctgttttggttgggttcttatcccagcaattacattcattatactgacaatattaaaattcattgcaaatattttccacacaagcaatcaggagaatagactgaagtcagtgctaagaaagataaaggaagaatttgaaaggacaaagggatcaatggtgtgtgatgtttgtaaatatgaatgtgaaacttataaggaattgaaagcacatggagtatcatgcccacaatcacaatgcccatattgtttcacccactgtgagcccacagaagctgcatttcaggcccattacaaagtctgtcaagtcactcatagatttagggatgacttgaagaagacagttacccctcaaaacttcacacctggttgctatcgtacattgaatttgtttagatataaaagcaggtgttatatctttacaatgtgggtctttctcttagtcttagagtcaatcctttgggccgctagtgcatcagaaacacctttaaatcctgtttggaatgataatgcccacggggtaggttctgtgcctatgcatacagatttggaactagatttttccctgacatcaagctctaagtacacctaccgaaggaagctaacaaatccacttgaagagtctcaagcaattaatctccatattgaaatagaagaacagacaattggtgtagatgtacatgctttaggccattggtttgatggccgccttaatcttaagacatccttccactgttatggtgcatgtacaaaatatgaatacccatggcatactgcaaaatgccattatgaaagggactatcaatatgagacaagctggggttgtaacccatcagattgtcctggtgtaggtacaggttgtactgcatgtgggttatatcttgatcaattaaaacctgttggcagtgcctacaaaattatcacaataagatatagcagaagggtctgtgtccaatttggggaagagaatctctgtaagattatagatatgaatgattgcttcgtgtctagacatgttaaagtttgtataattggcacagtttcgaaattctctcaaggtgatacactattattctttggaccacttgaaggtggtggtttaatattcaaacattggtgtacatcaacatgtcagtttggggatcctggagatatcatgagtccaagagataaaggatttttatgtcctgaattccctggtagttttagaaagaagtgtaactttgcaaccactcctatttgtgagtatgatgggaatatggtctcaggttataagaaagtaatggccacaattgattctttccaatccttcaatactagtactatgcatttcactgatgagaggatagaatggaaagatcctgatgggatgttgagagaccatataagcatcttggtaacaaaggatattgattttgataaccttggtgagaacccatgcaaaattggattacaaacatcatccattgaaggggcatggggctctggtgtaggatatacacttacatgtttgatctcactgacagagtgccctactttcttgacctcaatcaaggcttgtgataaagcaatctgttatggtgcagagagtgtgacattaacaagggggcagaacacagttaaggtgtcagggaaaggcggacatagcggttcatcctttaaatgctgtcatggagaagactgctctcagataggactccatgcagctgcaccacatcttgacaaagtcaacggaatttctgaaatagaaaacagtaaagtgtttgatgatggggcaccacaatgtggaataaagtgctggtttgtgaaatcaggagaatggatttctgggatttttaatggtaactggattgtgcttattgtcctgtgtgtcttcttactattctcactggtattacttagtattctctgtcctgttagaaaacataagaagtcatga

SEQ ID NO: 3337 - RNA, 3408 nt, synthetic construct
  misc_feature 1..3408: note = derived and/or modified CDS sequence (wt) from HTNV(HV004)__JQ083394.1__GP
  source 1..3408: mol_type = other RNA
atggggatatggaagtggctagtaatggccagtttagtctggccagcctttgcactaagaaatgtttatgacatgaaaattgagtgcccccacacagtcagttttggagaaaacagtgttataggttatgtcgaattgcctcctatgccactggctgacacagcacaaatggtgccagaaagctcctgcagcatggataatcaccaatcattaaatacaatcacaaaatatactcaaataatatggagagggaaagctgatcagtcacagtccagccagaactcgtttgagacagtgtctactgaggttgatcttaaaggaacctgtgtgttaaaacacaagatggttgaagaatcataccgcagtcggaagtcaataacttgttatgatctgtcttgtaatagtacctactgcaagccaacactttacatgattgtcccaatccacgcatgtaatatgatgaaaagttgtttaattgcactagggccttatagggtccaggttgtttatgaaagaacctactgcatgacaggagttttaattgagggaaaatgttttgttcctgaccagagtgttgtcagtatcatcaagcatgggatttttgatattgcaagtgttcacatcgtttgtttctttgttgcagttaaaggaagcacatataaactctttgaacaggttaaaaaatcatttgaatctaactgtaatgatactgagaacaaggtgcagggatattacatctgcattgttgggggaaattcagcacccatatatgtaccaacactggacgattttaggtcgatggaagcattctcagggatttttaaatcaccacatggggaagaccatgatctggctggggaagaggttgcatcatattctattgttggacctgctaatgcaaaggtgccccatagtgccagttcagacacactgagcttaattgcctattctggtataccatcttattcttctcttagcatccttacaagctcaacagaagcaaagcatgtattcagccctggattatttcctcagcttaaccatacaaaatgtgataaaactgccataccattgacatggacaggaatgattgaccttcccggatactatgaagctatacatccttgcacagttttctgtgtcctgtcaggtcctggagcttcttgtgaggcattctctgaagggggaatctttaacataacttctccaatgtgtctagtgtcaaagcagaatcgctttagattaactgaacagcaggtgaactttgtatgccagagagttgatgttgacattgttgtgtattgcaatggtcagagaaaagtaatcttaacaaagactttagttattgggcaatgcatatatactataacaagcctattttcactattacctggagttgcacattcaattgcagttgaattgtgcgtccctggattccatgggtgggctacagctgcactacttgtcacattctgttttggttgggttcttatcccagcaattacatttattatactgacaatattaaaattcattgcaaatatcttccacacaagcaatcaggagaataaactgaagtcagtgttaagaaagataaaagaagaatttgaaaggacaaaaggatcaatggtgtgtgatgtttgtaaatatgaatgtgaaacttataaggaattgaaagcacatggagtatcatgcccacaatcacaatgcccatattgtttcacccactgtgagcccacagaagctgcatttcaggcccattacaaagtatgtcaagttactcatagatttagggatgacttgaagaaaacagttacccctcaaaatttcacacctggttgctatcgtacattgaatttgtttaggtataaaagtaggtgttatatctttacaatgtgggtctttctcttagtcttagagtcaatcctctgggccgccagtgcatcagaaacacctttaaatcctgtttggaatgataatgcccacggggtaggttctgtaccaatgcatactgatttggaactagatttctccctgacttcaagctctaagtacacctaccgaaggaagctaacaaatccacttgaagagtctcaagcaattaatctccatattgaaatagaagaacagacaattggtgtagatgtacatgccttaggccactggtttgatggccgccttaatcttaagacatccttccactgttatggtgcgtgtacaaaatatgaatacccatggcatactgcaaaatgccattatgaaagggactatcaatatgagacaagctggggttgtaacccatcagattgtcctggtgtaggtacaggttgtactgcatgtgggttatatcttgatcaattaaaacctgttggcagtgcatacaaaattattacaataaggtatagcagaagggtctgtgtccaatttggggaagagaatctctgtaagattatagatatgaatgattgcttcgtgtctagacatgttaaagtttgtataattggcacagtttctaaattctctcaaggtgatacactcttattctttggaccacttgaaggtggtggtttaatattcaaacattggtgtacatcaacatgtcagtttggggatcctggagatatcatgagtccaagagataaaggatttttatgccctgaattccctggtagttttagaaagaagtgtaactttgcaaccactcctatttgtgaatatgatgggaatatggtctcaggttataaaaaagtaatggccacaattgattctttccagtccttcaatactagtactatgcatttcactgatgagaggatagaatggaaagatcctgatgggatgttgagagaccatataaacatcctggtaacaaaagatattgattttgataaccttggtgagaacccatgcaagattggattacagacatcatccattgagggggcatggggctctggtgtaggatttacacttacatgtttgatctcattgacggagtgccctactttcttgacctcaatcaaggcttgtgataaagcaatttgttatggtgcagagagtgtgacattaacaagggggcaaaacacagttaaggtgtcagggaaaggcggacatagcggctcatcctttaaatgctgtcatggagaagactgctctcagataggactccatgcggctgcaccacatcttgacaaagtcaacggaatttctgaaatagaaaacagtaaagtgtttgatgatggggcaccacaatgtggaataaagtgctggtttgtgaaatcaggagaatggatttctgggatcttcaatggtaactggattgtgcttattgtcctgtgtgtcttcttactattctcattggtattacttagtattctctgtcctgttagaaaacataagaaatcatga

SEQ ID NO: 3338 - RNA, 3405 nt, synthetic construct
  misc_feature 1..3405: note = derived and/or modified CDS sequence (wt) from HTNV(NC167)__AB027115.2__GP
  source 1..3405: mol_type = other RNA
atgtgggggttactggtagtggccggtttaatcggcccatgtatatcactgagaaatgtttatgacatgaagatagagtgcccgcatacagtcaactttggtgaaaacagtgtgataggctatgtggaattgccgccagtgccaatagctgatattacccagatggttcccgaaagttcttgtaatatggataaccaccagtccctcagcacatttacaaaatacacacaactcatttggaggaaaaaggctgagcaggcacaagcaagccagaattcatttgaaactgtctcaagagaggttgattttaaagggacttgtgtgttcaagcataaaatggttgaggagtcttacaaaaatcggaagtctatcatttgttatgatctatcatgcaatattacccattgtaaaccaaccctttacatgataattccagtgcatgcatgcaacatgatgaaaagctgcttaattgcacttggcccatttagggttcaagtggtctatgagagaacttattgcatgtcgggcatactcacagaagggcggtgcttcgtaccataccagagtgtagtgagtattatcaagcatgggatctttgatattgcaagtatccatatcatctgcttttttatagctgtggaagggaacacctacaaattatttgaagaggtaaagaagtcatttgccctaaattgtaatgatacagagaataaaattcagggttattacatatgcatcataggagggaattcagcacctgtttatgccccatcacctgatgactttagatccatggaggcattttcaggtattttcaggtcgccgcatggagaaaatcatgatctaaatgggggaagaaatgcaccatattctattgttggcccaacagatggaaaggttcctcatagttccaagcactacaacattgagtttgacagcattttccagaaattcccgacatattcttcatttagtattcttgcaggttctgtggagccaaagcatgtcttccagccaggattatttccaaagttgaatcatacaaaatgcacaaagtctgcaattccattggtctggactggtcgaattgatattcccggttactatgaggctgtccatcccttgacagtttattgtgagctgtctggcccaggggcatcatgtgaagccttttctgaaggggggatcttcaatatcacatctccgatgtgtcttgtgtcaaaacaaaatagattcagatccctcagacagcaagttagctttgtgtgccagagagttgacatggatatagttgtgtattgtaatggccagaaaaagaccatattaaccaaaacacttgtgataggtcagtgtatttacacaataacgagcctgttttctctgctgccgagtgttgcacactcaattgctgtagagctttgtgttcctgggtttcatggttgggcaactgcagcactgctaataacattctgctttggctgggttttgataccggcattaacttttatcatattaaccatactcaagtttattgcaaatatctttcatacaagcaatcaggaaaataaattaaaggctgtcctaaggaaaattaaagaggagtttgaaaaaacaaaaggctcaatggtatgtgatatttgtaaatatgaatgtgatacatacaaagagctaaaggctcacggcctatcatgtccacaatctcaatgcccatattgctttacacactgtgaaccaacagagtcggcttttcaggctcactataaagtctgtcaagtgacacacagattcagggaagaattaaaaaagacagttacaccacaaaactttacccctggttgttacaggacattaaaccttttcaggtataaaagtaggtgctacatctttacaatgtggatcctcttactagtctttgaatctatcttgtgggctgcaagtgcttctgatgtccctttatcaactgactggaatgacaatgcacatggtgttgggtcagtgcctatgcacactgatcttgaacttgacttttcactcacgtcaagttctaaatatacatacaggcggaaactcacaaaccctgtggatacctctcaggcagtggacttgcatattgaactagaagagcaaacaattgggttggatgtccatgccttagggcactggtttgatggccgtttaaatctcaagacatcctttcactgttacggagcatgcactaaatatgagtacccatggcatacagctaagtgccattttgaaagagattttcagtatgaaacaagttggggctgtaatccccctgactgccctggtgtagggactgggtgcactgcatgtggtctttatattgatcagttaaggccagtgggaaatgcttacaaaattataacaattaggtatagcagaaaggtttgtgtacaatttggtgatgaaaatctctgtaaaaccattgacatgaatgattgttttgtatccaaacatgttaaagtttgtatcattgggacagtctctaaattttctcaaggtgatactctattgttcttgggccctatggaaggaggcgggatcatctttaaacattggtgtacatccacctgccaatttggggaccctggtgatattatgagtcccaaggataagggattcagctgccctgagttttcagggagttttagaaagaaatgcaattttgcaacaacccccgcgtgtgaatatggtggtaatatggtttcaggctacaggaaagtgatggcaactattgattcattccaagcatttaatacaagtactatacatttcacagatgagcgaattgagtggaaagacccagatgggatgcttcgtgatcacatcaatatattagtaacaagggacattgactttgacaacctggctgagaatccatgtaaaattggcctccaagtatctgccattgaaggtgcatggggatctggggttggctttacattaacatgtcaagtctccctaacggagtgttcaacattcctgacctcaattaaagcatgtgataaggcaatttgttatggtgcacagagtgtaacacttgtgagagggcaaaacacagttaaaatttctggtaaaggggggcatagtggttctgccttcaaatgctgccatggggaggattgttcacagacaggattgcaggcagatgcaccacaccttgataaagtcaatggcatttcagaagtagagaatgataaagtgtatgatgatggggcacctgagtgtggtataaagtgttggtttgtaaaatcaggagaatgggtagcagggatatttagtggaaattggattgtgcttgttgtcctctgtattttccttataatatctctcattttgcttagcatcttatgccctgttaggaagcacaaaaagtcatag

SEQ ID NO: 3339 - RNA, 3408 nt, synthetic construct
  misc_feature 1..3408: note = derived and/or modified CDS sequence (wt) from HTNV(WuhanAaJ10)__JQ665882.1__GP
  source 1..3408: mol_type = other RNA
atggggatatggaagtggctagtaatggccagtttagtctggccagcctttgcactaagaaatgtttatgacatgaaaattgagtgcccccacacagtcagttttggagaaaacagtgttataggttatgtcgaattgcctcctatgccactggctgacacggcacaaatggtgccagaaagctcctgcagcatggataatcaccaatcattaaatacaatcacaaaatatactcaaataatatggagaggaaaagctgaccagtcacagtccagccagaactcgtttgagacagtgtctactgaggttgatcttaaaggaacctgtgtgttaaaacacaagatggttgaagaatcataccgcagtcggaagtcaataacttgttatgatctgtcttgtaatagtacctactgcaagccagcactttacatgattgtcccaatccatgcatgtaatatgatgaaaagttgtttaattgcactagggccttatagggtccaggttgtttatgaaagaacctactgcatgacaggagttttaattgagggaaaatgttttgttcctgaccagagtgttgtcagtatcatcaagcatgggatctttgatattgcaagtgttcacactgtttgtttcttcgttgcggttaaaggaagcacatataaactctttgaacaggctaaaaaatcatttcaatctaactgtaatgatactgagaacaaggtgcagggatattacatctgcattgttgggggaagttcggcacccatatatgtaccaacactggatgattttaggtcgatggaagcattctcagggctttttaaatcaccacatggggaagaccatgatctggctggggaagaggttgcatcatattctattgttggacctgctaatgcaaaggtgccccatagtgccagttcagacacactgagcttaattgcctattctggtataccatcttattcttctcttagcatcctcacaagctcaacagaagcaaagcatgtattcagccctgggttatttcctcagctcaaccatacaaagtgtgacaaaactgccataccattgacatggacaggaatgattgaccttcccggatactatgaagctgtacatccttgcacagttttctgtgtcctatcaggtcctggagcttcttgtgaggcattctctgaagggggaatctttaacataacttctccaatgtgtctagtgtcaaagcagaatcgctttagattaactgaacagcaggtgaacttcgtatgccagagagttgatgttgacattattgtgtattgcaatggtcagagaaaagtaatcttaacaaagactttagttattgggcaatgtatatacactataacaagcttaatttcactactacctggggttgcacattcaattgcagttgaattgtgtgttcctggatcccatgggtgggctacagctgcactacttgttacattctgttttggttgggttcttatcccagcaattacattcattatcctgacaatattaaaattcattgcaaatatcttccacacaagcaatcaggagaatagactgaagtcagtgctaagaaagataaaggaagaatttgaaaggacaaaaggatcaatggtgtgtgatgtttgtaaatatgaatgtgaaacttataaggaattgaaagcacatggagtatcatgcccacaatcacaatgcccatattgtttcacccactgtgagcctacagaagctgcatttcaggcccattacaaagtctgtcaagttactcatagatttagggatgacttgaagaagacagttacccctcaaaatttcacacctggttgctatcgtacattgaatttgtttagatataaaagtaggtgttatatttttacaatgtgggtctttctcttagtcttagagtcaatcctttgggctgccagtgcatcagaaacacctttaaatcctgtttggaatgataatgcccacggggtaggttctgtgccgatgcatacagatttggaactagatttctcactgacatcaagctctaagtacacctaccgaaggaagttaacaaatccacttgaagagtctcaagcaattgatctccatattgaaatagaagaccagacaattggtgtagatgtacatgccttaggccattggtttgatggccgccttaatcttgagacatccttccactgttatggtgcatgtacaaaatatgaatacccatggcatactgcaaaatgccattatgaaagggactatcaatatgagacgagctggggttgtagcccatcagattgtcctggtgtaggtacaggttgtactgcatgtgggttgtatcttgatcaattaaaacctgttggtagtgcctacaaaattattacaataagatatagcagaagggtctgtgtccaatctggggaagagaatctctgtaagattatagatatgaatgattgcttcgtgtctagacatgttaaagtttgtataattggcacagtttcaaaattctctcaaggtgatacactcttattctttggaccacttgaaggtggtggtttaatatttaaacattggtgtacatcaacatgtcagtttggggatcctggagatatcatgagtccaagagataaaggatttttatgccctgaattccctggtagttttagaaagaagtgtaactttgcaaccactcctatctgtgagtatgatgggaatatggtctcaggttataaaaaagtaatggccacaattgattctttccaatccttcaatactagtactatgcatttcactgatgagaggatagaatggaaagatcgtgatgggatgttgagagaccatataaacatcttggtaacaaaagatattgattttgataaccttggtgagaatccatgtaaaattggattgcaaacatcatccattgaaggggcatggggctctggtgtaggatttacacttacatgtttgatatcattgacggagtgccctactttcttgacctcaatcaaggcttgtgataaagcaatctgttatggtgcagagagtgtgacattaacaagggggcaaaacacagttaaggtgtcagggaaaggcggacatagcggttcatcctttaaatgttgtcatggagaagactgctctcagataggactccatgcagctgcaccacatcttgacaaagtcaatggaatttctgaaatagaaaacagtaaagtgtttgatgatggggcaccacaatgtggaataaagtgctggtctgtgaaatcaggagaatggatttctgggattttcagtggtaactggattgtgcttattgtcctatgtgtcttcttactattctcactggtattacttagtattctctgtcctgttagaaaacataagaagtcatga

SEQ ID NO: 3340 - RNA, 3408 nt, synthetic construct
  misc_feature 1..3408: note = derived and/or modified CDS sequence (wt) from HTNV(Z5)__EU074224.1__GP
  source 1..3408: mol_type = other RNA
atggggatatggaagtggctagtgatggccagtttagtatggccagcttgtacactaagaaatgtgtatgacatgaaaattgagtgcccccacacagtcagctttggtgaaaacagcgtgataggttatgtggaattgccccctatgccattggctgatacagcacaactggtgcctgaaagttcttgtaacatggacaaccaccaatcaatgaatacaataacaaaatatacccaggtaagttggagaagtaaggttgaccaggcacaagccagccaaaattcatttgaagcagtgtctgctgaagttgatcttaaaggaacatgtgttttaaagcataaaatgctggaggaatcataccgcagtagaaaatcaattacttgctatgacctctcatgcaacagcacctactgtaagcccaccctctacatgatcgtaccaattcatgcatgtaacatgatgaaaggttgcttaattgcattagggccttacagagtacaagtggtctacgaaagaacctactgcatgacaggggtcctgatagaaggaaaatgttttgttccagaccagagtgttgttagtatcatcaaacatgggatttttgatatagcaagtgttcacattgtttgtttctttgtagcggttaagggaaacacatataaactgtttgaacaggtcaaaaagtcatttcaatccacatgtaatgatactgaaaataaagtgcagggatattacatctgtattgtggggggaaactctgcaccaatatgtgtaccaacacttgatgattttaggtccatggaggcattttcagggatttttagatcaccacatggagaagaccatgacctagctggggaagagattgcttcttactctattgttggacctgccaatgcaaaagtgcctcacagtgctagctcagatacattaagcctaattgcctattctggtataccatcctattcttcactcagcattcttgcaggctctacagaagctaagcatgtatttagccctggtttttttccacaacttaatcacacaaagtgtgacaagactgccatcccgcttacttggacagggatgattgacttgcctggatactacgaagctatacatccttgtacagtcttctgtgttttatcaggccctggggcatcatgtgaagcattttctgaaggcgggattttcaacataacatcccctatgtgcttagtatcaaaacaaaatcgattccggttgacagagcagcaggtaaactttgtgtgtcagagggttgatatggacattattgtgtattgtaatggacagaggaaagtgatactgacaaaaaccttagtcataggacagtgtatatatactataacaagtttattctcactactgcctggggtagcacactctattgctgttgaactctgtgtgcctgggttccatggttgggctacagctgccctacttgtcacattctgctttggatgggttcttataccagcaataacatttgttatcctcacaattttaaagttcattgcaaatattttccacacaagtaaccaagggaataggcttaaatcagtattaaagaaaataaaggaagaatttgaaaagacaaaagggtcaatggtgtgtgatgtctgtaagtacgagtgtgaaacttataaagaactgaaggcgcatggggtttcatgccctcaatctcaatgtccatattgctttactcattgtgaacctacagaagcagcattccaggcccattatagagtgtgccaagtcacccatagattcagggatgacttaaagaagactgttactcctcaaaactttacacctggttgttatcggacactaaacttgttcagatataaaagtagatgttatatttttacaatgtgggtctgccttctggtcctggagtcaatactttgggctgcaagtgcttcagaagtacccttaaatcctatatggaatgataatgctcatggggtagggtctgtgccaatgcatacagatttagagctggacttttccttgacatcaagctcaaagtatacataccgcagaaggctgacaaatccacttgaggaaacacaagcaattaaccttcacattgaaatagaagaacaaacaattggtgttgatgtacatgccctaggtcattggtttgatggcaggcttaacctgaaaacatctttccactgttatggcgcctgcacaaaatatgagtatccctggcatactgcaaagtgtcactatgaacgggattaccagtatgagacaagttggggctgtaacccagctgattgcccaggggtgggaacaggttgcacagcatgtggattataccttgatcaattaaagcctgttggtagtgcatataaaattattacaataagatatagcagaaaagtttgtgttcagtttggggaagaaaatctatgtaaagtgatagacatgaatgattgctttgtatctagacatgtcaaagtatgtataattggtacagtctctaaattttctcaaggtgatacactattattctttggaccacttgagggcggtggtctaatatttaaacactggtgcacatctacatgccagtttggagacccaggagatattatgagtcctcgagataagggatttttatgccctgaattccctggaagctttaggaaaaaatgcaattttgccactacccctctttgtgagtatgatggcaatatggtttcaggttacaagaaagtaatggcaactattgactcttttcaatccttcaacaccagtactatgcactttactgatgagagaatagagtggaaagacccagatggaatgttaagggaccatataaacattctggtaactaaggatattgactttgataatctcggtgaaaacccatgtaaagttggcttgcagacatcctcaattgaaggggcctggggatctggtgtaggttttacacttacatgcctagtatctttaacagagtgtcctactttcttgacttcaattaaggcgtgtgacaaagccatatgctatggtgcagaaagtgtgacattaacgagaggccagaacacagtaaaggtgtcaggtaaaggtggtcatagtggttcaaccttcaaatgctgtcatggagaagaatgttcacaaattggactccatgctgctgcacctcaccttgataaagtcaatggaatttctgaaattgaaaataacaaagtatatgatgatggagcaccccagtgtggagtaaagtgctggtttgtaaaatctggagaatggatttcagggatcttcagtggaaattggattgtgctcattgttctttgtgtattcttattgttttcactggcgttgctcagtgtcctttgtcctgtcaggaggcataaaaagtcataa

SEQ ID NO: 3341 - RNA, 3408 nt, synthetic construct
  misc_feature 1..3408: note = derived and/or modified CDS sequence (wt) from HTNV(ZLS-12)__FJ753399.1__GP
  source 1..3408: mol_type = other RNA
atggggatatggaagtggctaataatggccagtttagtgtggccagcttatacactaagaaatgtgtatgacatgagaattgagtgcccccatacagtcagttttggtgaaaacagtgtgataggctatgtggaactcccccctatgccattggctgatacatcacaaatggtgccagaaagttcctgcagcatggacaaccaccaatcactgaatacgataacaaagtatactcaggtaagttggagaggcaaggctgatcagtcacaggccagccagaactcatttgaggcagtttctgctgaagttgaccttaaggggacatgtgtcttgaagcacaagatgctagaagagtcataccgtagcagaaaatcaataacctgctatgacctttcctgcaacagtacctattgtaagcctaccctgtacatgattgtaccaatccatgcatgcaacatgatgaaaagctgtttaattgcattaggaccttatagagtacaagtagtttatgaaagaacctattgcatgacagggatcttgatagaaggaaaatgctttgttccagatcagagtgtagttagtatcatcaaacatggaatttttgacattgcaagtgtccatattgtctgtttctttgtggcagtcaaaggaaacacctacaaacttttcgaacaggtcaaaaagtcatttcagtccacatgcaatgatactgaggataaagtccagggttactatatctgtattgcaggagggaactcagcacctatatatgtgcctacacttgatgattttaggtctatggaggcattctcagggatttttaagtcaccacacggggaagaccatgacctagctggagaagagattgcttcatactctattgttggacctgctaatgcaaaagtaccccatagtgctagctcagatacactaagcctaactgcttactcaggtataccatcttattcctcacttagtattctaacaagttcaacagaagctaagcatgtatttagccctggattttttccacaacttaaccatacaaagtgtgacaaaacagccataccgttaatgtggacagggatgattgacctgcctggatactatgaggccatacatccctgtacagttttctgtgttttatcaggtcctggagcatcatgtgaggcattttcagagggtggtatttttaatataacatctcccatgtgcctagtgtcaaaacaaaatcgattccgactgacagaacaacaggtaaactttgtatgccaaagagttgatatggacattgttgtatattgcaatggtcagagaaaagtgatactgacaaagaccttagtcataggacagtgcatatataccattacaagtctattttcattattacctggggtagcacattccatcgctgttgaattatgtgtccctggtttccatgggtgggctactgctgcccttcttgtcacattctgttttgggtgggttcttataccagcaattacatttatcatactaacaatcctaaaatttattgcaaatattttccacacaagcaatcaagaaaataggctcaaatcagtgttgaggaaaataaaggaagaatttgagaaaacaaaaggttcaatggtgtgtgatgtctgtaaatatgagtgtgaaacatacaaagaattaaaggcacatggggtctcatgccctcaatcacagtgtccatactgttttactcattgtgaacccacagaagcagcatttcaggctcattatagagtctgtcaggtcacccatagattcagagatgatttaaaaaagactgttaccccgcaaaactttacacctggttgctatcgcacactaaacctatttagatacaaaagcaggtgttacattttcacaatgtgggtcttcctactagtcttggaatcgatactctgggctgccagtgcatcggaggtacctttaagtcctgtatggaatgataacgcccatggggtagggtctatcccgatgcatacagacttagaacttgacttttccttaacatcaagctccaagtatacataccgccggaaattaactaatccgcttgaagaaactcaggcaatcaacctccatattgaaatagaagaacagacaattggtgttgatgtacatgccttagggcattggtttgatggtcgtcttaatcttaaaacatccttccactgctatggtgcttgtacaaagtatgaatatccatggcatactgccaaatgccactatgagagagattaccagtatgagacaagttggggctgtaatccagctgattgcccaggggtgggtacaggctgtacagcatgtggactttaccttgaccagctaaaacctgttggcagtgcttacaaaattatcacaataagatatagcaggagagtgtgtgttcaacttggggaagaaaacctatgcaagattatagacatgaatgattgctttgtctccaggcatgttaaagtctgtataattggcacagtatctaagttctctcaaggtgacacattactattctttggaccacttgaaggtggtggtctaatatttaaacactggtgcacatccacatgccagtttggtgatcctggggatatcatgagtccaagggataagggatttttgtgccctgagtttcctggtagttttagaaagaaatgtaattttgccaccaccccgctttgtgaatatgacggaaatatggtttcaggctataaaaaagtaatggcaacaattgattcttttcaatccttcaatactagtaccatgcacttcactgacgagaggataaagtggaaagaccctgacgggatgttaagggaccatattaatatcctggtaaccaaggatattgactttgataatcttggtgaaaacccttgtaagatcggcttacagacatctgcaattgagggtgcatggggttcaggtgtaggttttacacttacatgcctagtttcattgacagagtgccctaccttcttgacatcaattaaggcttgtgataaagccatctgttatggtgcagaaagtgtaacattaacacgaggacagaacacagtcaaggtatcagggaagggtggtcatagcggttcactttttaagtgctgtcatggggaagaatgctcacaaattgggctccatgctgctgcacctcaccttgacaaagtaaacggaatttctgaaattgagaataataaagtttatgatgatggggcacctcaatgtggagtcaaatgctggtttgtaaagtctggagaatggatttcagggatttttagtgggaactggattgtacttattgtcctctgtgtattcctattattttcgcttgtattacttagtgtcctctgtcctgtaagaaagcacaaaaaatcatag

SEQ ID NO: 3342 - RNA, 3408 nt, synthetic construct
  misc_feature 1..3408: note = derived and/or modified CDS sequence (wt) from HTNV(ZLS6-11)__FJ753397.1__GP
  source 1..3408: mol_type = other RNA
atggggatatggaagtggctaataatggccagtttagtgtggccagcttatacactaagaaatgtgtatgacatgagaattgagtgcccccatacagtcagttttggtgaaaacagtgtgataggctatgtggaactcccccctatgccattggctgatacatcacaaatggtgccagaaagttcctgcagcatggacaaccaccaatcactgaatacgataacaaagtatactcaggtaagttggagaggcaaggctgatcagtcacaggccagccagaactcatttgaggcagtttctgctgaagttgaccttaaggggacatgtgtcttgaagcacaagatgctagaagagtcataccgtagcagaaaatcaataacctgctatgacctttcctgcaacagtacctattgtaagcctaccctgtacatgattgtaccaatccatgcatgcaacatgatgaaaagctgtttaattgcattaggaccttatagagtacaagtagtttatgaaagaacctattgcatgacagggatcttgatagaaggaaaatgctttgttccagatcagagtgtagttagtatcatcaaacatggaatttttgacattgcaagtgtccatattgtctgtttctttgtggcagtcaaaggaaacacctacaaacttttcgaacaggtcaaaaagtcatttcagtccacatgcaatgatactgaggataaagtccagggttactatatctgtattgcaggagggaactcagcacctatatatgtgcctacacttgatgattttaggtctatggaggcattctcagggatttttaagtcaccacacggggaagaccatgacctagctggagaagagattgcttcatactctattgttggacctgctaatgcaaaagtaccccatagtgctagctcagatacactaagcctaactgcttactcaggtataccatcttattcctcacttagtattctaacaagttcaacagaagctaagcatgtatttagccctggattttttccacaacttaaccatacaaagtgtgacaaaacagccataccgttaatgtggacagggatgattgacctgcctggatactatgaggccatacatccctgtacagttttctgtgttttatcaggtcctggagcatcatgtgaggcattttcagagggtggtatttttaatataacatctcccatgtgcctagtgtcaaaacaaaatcgattccgactgacagaacaacaggtaaactttgtatgccaaagagttgatatggacattgttgtatattgcaatggtcagagaaaagtgatactgacaaagaccttagtcataggacagtgcatatataccattacaagtctattttcattattacctggggtagcacattccatcgctgttgaattatgtgtccctggtttccatgggtgggctactgctgcccttcttgtcacattctgttttgggtgggttcttataccagcaattacatttatcatactaacaatcctaaaatttattgcaaatattttccacacaagcaatcaagaaaataggctcaaatcagtgttgaggaaaataaaggaagaatttgagaaaacaaaaggttcaatggtgtgtgatgtctgtaaatatgagtgtgaaacatacaaagaattaaaggcacatggggtctcatgccctcaatcacagtgtccatactgttttactcattgtgaacccacagaagcagcatttcaggctcattatagagtctgtcaggtcacccatagattcagagatgatttaaaaaagactgttaccccgcaaaactttacacctggttgctatcgcacactaaacctatttagatacaaaagcaggtgttacattttcacaatgtgggtctttctactagtcttggaatcgatactctgggctgccagtgcatcggaggtacctttaagtcctgtatggaatgataacgcccatggggtagggtctatcccgatgcatacagacttagaacttgacttttccttaacatcaagctccaagtatacataccgccggaaattaactaatccgcttgaagaaactcaggcaatcaacctccatattgaaatagaggaacagacaattggtgttgatgtacatgccttagggcattggtttgatggtcgtcttaatcttaaaacatccttccactgctatggtgcttgtacaaagtatgaatatccatggcatactgccaaatgccactatgagagagattaccagtatgagacaagttggggctgtaatccagctgattgcccaggggtgggtacaggctgtacagcatgtggactttaccttgaccagctaaaacctgttggcagtgcttacaaaattatcacaataagatatagcaggaaagtgtgtgttcaatttggggaagaaaacctatgcaagattatagacatgaatgattgctttgtctccaggcatgttaaagtctgtataattggcacagtatctaagttctctcaaggtgacacattactattctttggaccacttgaaggtggtggtctaatatttaaacactggtgcacatccacatgccagtttggtgatcctggggatatcatgagtccaagggataagggatttttgtgccctgagtttcctggtagttttagaaagaaatgtaattttgccaccaccccgctttgtgaatatgacggaaatatggtttcaggctataaaaaagtaatggcaacaattgattcttttcaatccttcaatactagtaccatgcacttcactgacgagaggatagagtggaaagaccctgacgggatgttaagggaccatattaatatcctggtaaccaaggatattgactttgataatcttggtgaaaacccttgtaagatcggcttacagacatctgcaattgagggtgcatggggttcaggtgtaggttttacacttacatgcctagtttcattgacagagtgccctaccttcttgacatcaattaaggcttgtgataaagccatctgttatggtgcagaaagtgtaacattaacacgaggacagaacacagtcaaggtatcagggaagggtggtcatagcggttcactttttaagtgctgtcatggggaagaatgctcacaaattgggctccatgctgctgcacctcaccttgacaaagtagacggaatttctgaaattgagaataataaagtttatgatgatggggcacctcaatgtggagtcaaatgctggtttgtaaagtctggagaatggatttcagggatttttagtgggaactggattgtacttattgtcctctgtgtattcctattattttcgcttgtattacttagtgtcctctgtcctgtaagaaagcacaaaaaatcatag

SEQ ID NO: 3343 - RNA, 3408 nt, synthetic construct
  misc_feature 1..3408: note = derived and/or modified CDS sequence (wt) from HTNV__AB030232.1__GP
  source 1..3408: mol_type = other RNA
atgggtttatggaagtggctaataatggccgttttggtgtggccatgttttgccctaaggaatgtatatgacatgaagattgaatgcccccatacagtcaattttggggaaaacagtgtggtcgggtatgtggagctaccgcctatgccaatcgctgacatcactcagatgatgccagagagctcttgcagcatggataaccaccaatctctaaacacaatcacaaagtacacccaagtgagttggagaaagaaagctgaccgagcacagtcaagccaaacctcctttgagacagtttcttccgaggtggactttaaaggaacctgtgtattaaagcacaagatggtagaggattcctatcgcagccgtaagtcaataatctgttatgatctttcatgcaatagtacattctgtaagcctaccctttatctaattgtgcctgtgcatgcctgtaacatgatgaagagctgcctaatagcattaggcccctatagagttcaagatgtctatgagaggacatactgtatgtcaggggtccttctagaaggaaaatgctttgtaccagaccggagtgttgtgagcattataaaacatggcatatttgatattgcaagtgtccatattgtttgcttttttgttgcaatcaagggcagtacatataaaatccttgaacaagttaaaaaatcatttgaactaacatgcaatgatactgataataagattcaggggtattatatatgtcttgtgggagggaattcagcacccatatatgtgccaacccttgatgacttcaggtcaatggaggcatttgctgggatttttaagtccccacatggggaagatcacgaccttgcaggggaggaagtagcctcttattccattgtagggcctgccaatgcaaaagtaccccacagtgccagtgcagatacactgagtttagttgccttttcaggaatcccatcctactcatccttcagtgtcctcacaggatctacagatgcccgtcatgtctttagcccaggtttctttccacaactaaaccagacaaggtgtgataaaactgccataccattaacctggacaggaatgattgacctacctggttattatgaagcagtacacccttgcactgtcttctgtgttttgtccggtcctggtgcgtcatgtgaagccttttctgaaggcgggatctttaatataacttctcccatgtgtttagtctcagagcaaaatcgctttaggtcatcagagcaacaagtgaactttgtttgtcaaagagtagatatggatattgtggtctattgtaatgggcaaaagaaagtaatattaacaaaaactctagtaattggccaatgtatatatacaataaccagcttattttcattgcttcctggtgttgcacattctattgctgtagaactgtgtgttcctggcttccacggttgggctacagctgctttgcttgtaacattttgctttggctgggttttaatacctgcagtcacccttgtcatattaacaattttaaagtttattgcaaacatcttccatacaagcaatcaggaaaatcggctcaaatcagttttgaagaaaatcaaggaagaatttgagaagactaaaggctccatggtttgcgatgtgtgtaaatatgaatgtgagacatataaagagttgaaggcacatggagtatcatgtcctcaatctcaatgcccatactgcttcacccactgtgagcctacagaagcagcatttcaagcccactacaaagtatgccaagtcactcatagatttcgggatgatttaaagaaaacagtgaccccccaaaattttacaccaggctgttatcgtaccttgaatctgtttagatataaaagccgatgttacatcttcacaatgtgggtatttttgctgatcctggaatccattttatgggctgcaagtgcttctgaaacaccctcaacccctatttggaatgataatgctcacggagtaggatctatcccgatgcacacagaccttgaattagatttttccctgacatctagctctaagtacacttatcgacggaagctcacaaacccacttgagaagactcaagcagtagatcttcatattgagttagctgtacagaccataggtgtagacgtgcatgctttggggcattggtttgacggccgcttaaatctaaagacctcctttcattgttatggtgcatgtacaaaatatgaatacccatggcatactgccaagtgtcactatgaaagggattatcaatatgagacaagctggggttgcaatcctgcagattgtcctggagttggaacaggctgtactgcatgtggtctatatttagaccaattaaaacctgttggcagtgcctataagatcattacaataaaatatagcagaagagtttgtgttcagtttggagaagaaaacctgtgcaaggtaattgacatgaatgactgctttgtatcaagacatgttaaaatctgtataataggtacagtctcaaaattttctcaaggtgatacactattattttttggcccgctagagggtggtggcttaatcttcaaacattggtgcacatccacgtgccagtttggggaccctggggatattatgagcccaagagataaaggcttcctttgtcctgaattccccgggagctttcgaaagaaatgcaactttgcaactactcctgtctgtgagtatgacgggaacatggtctcagggtacaagaaagtcatggctacaattgattcctttcaatcctttaatactagcatgatgcatttcactgatgaaagaattgagtggaaagatcctgatgggatgttgcgggaccatatcaacattttggttaccaaggatattgactttgacaaccttggtgacaatccatgcaaagttgggctacagacatcggctattgaaggggcatggggttcaggtgttggcttcacactgacatgtcaagtttccttaacagagtgtcctacttttctgacatcaattaaagcatgtgataaagcaatttgttatggtgcagaaagcataacacttacaaggggacagaatactgtcaaagtttcagggaagggtggacacagtggctcaacctttaaatgctgtcatggggaagagtgctcacaaattgggctccatgctgccgcacctcatctagataaagttaacgggatctcagagatggaaaacagcaaagtctatgatgatggagcaccagaatgtggcataaagtgctggtttgtgaagtcaggtgaatggatttcaggcatcttcaatggtaattggatagttctcattgtgttatgtgcatttttaatcttttcacttgtattattaagcctcctttgtcctgttagaaagcacaagaaggcatag

SEQ ID NO: 3344 - RNA, 3408 nt, synthetic construct
  misc_feature 1..3408: note = derived and/or modified CDS sequence (wt) from HTNV__AB620032.1__GP
  source 1..3408: mol_type = other RNA
atggggatgtggaagtggctagtaatagccagtttagtatggcctgttttggcactgagaaatgtgtatgacatgaaaattgaatgccctcacacagtaagtttcggagaaaacagtgtgatagggtttgtggagttaccccctatgccattggctgacacagcacagatggtgcctgagagttcttgcagcatggataatcatcagtcaataaacactataacaaaatacacccaggtaacctggagaggaaaggcagatccgggacaatccagtcagaattcattcgaaacagtgtctactgaagttgacttgaaaggaacatgtgttttaaagcataagatggtggaagaatcataccgcagccggaagtcaataacctgttatgacctttcttgtaatagtacttattgcaagccaacattatatatgattgtaccaatccatgcatgtaatatgatgaagagctgtctcattgcattagggccatacagagtgcaggtagtgtatgagagaacctactgtatgacaggagtcttaattgaaggaaaatgttttgtcccagatcaaagtgttgttagcattattaagcatgggatctttgatattgcaagtgttcatattgtatgtttctttgtcgcaattaaggggaacacctataaactctttgaacaggttaagaaatcatttgagtcaacttgcaatgatactgagaataaagtacagggttattacatctgcattgtgggaggaaattctgcaccaatctatgtccctacacttgatgatttcaggtccatggaggcattcacgggaatctttaaatcaccgcatggagaagaccatgaccttgctggggaggagattgcttcatactccatagttggacctgcaaatgcaaaagtccctcatagtgcaagctcagacacactaagtttaattgcttattcaggtataccatcttattcttccctgagtatcttgacaagttcaacagatgctaagcatgtgtttagccctgggttgttcccaaagctcaaccatacaaactgtgataagagtgcaataccgctcacatggactgggatgattgacttacctggatactatgaggccatacacccttgcacagttttttgtgtactgtcaggccccggagcatcatgtgaagcattttctgaaggtggcattttcaacataacttcccccatgtgcttagtctcaaaacaaaatcggttccggctaacagagcagcaggtgaacttcgtgtgtcaaagagtagacatggacattgttgtgtactgcaacgggcagcggaaagtaatattaacaaaaactttagttattgggcaatgtatatatactataacaagcttgttttcactactacctggggtagcacattctattgctgtggaactatgtgtgcctggattccatggctgggccacagctgctttgcttgttacattctgttttggatgggtccttataccggctgtcacatttgttatactaacaatcttaaagtttgttgctaacatttttcacacaagcaaccaagagaacaggctaaaatcagtattgagaaaaataaaggaggagtttgaaaagacaaaggggtcaatggtatgtgatgtttgcaagtatgaatgtgaaacctataaagaattaaaggcacatggggtatcctgtccccaatctcaatgcccttactgttttactcattgtgagcctacagaggcagcatttcaagcccactataaagtatgccaggtaactcacaggttcagggatgatcttaaaaagactgtcactcctcaaaatttcacaccgggttgttatcggacattaaatttatttagatacaaaagtagatgttacatttttacaatgtgggtattccttctcattctggaatctgtactgtgggctgctagtgcatcagaaacaccgttagctcctgtttggaatgacaatgcccatggtgttggttctgtgcctatgcacacagatctggagcttgatttttctctgacatccagctctaagtatacataccgcagaaagctaacaaacccactggaagaggcacaatcaattgatctccatattgaaatagaagagcaaacaatcggtgttgatgtgcacgctctaggacattggtttgatggccgtcttaaccttaaaacatcctttcactgttatggtgcctgtacaaagtacgagtacccatggcatactgcaaagtgtcactatgaacgagattaccaatatgagacaagttggggttgtaatccatcagactgccccggggtgggtacaggctgtacagcatgtgggctttatcttgaccagttaaaaccagttggtagtgcatataaaatcattacaataagatatagtagaagagtctgtgttcagtttggagaagaaaacctttgtaaaattatagacatgaatgattgctttgtatctagacatgttaaagtctgtattattggaacagtttctaagttttcacaaggtgatacactattgtttttcgggccacttgaaggcggtggcttgatatttaaacactggtgtacatctacatgtcagtttggtgatccaggagacatcatgagcccaagggacaaaggttttttatgccctgagttcccaggtagttttagaaaaaaatgtaattttgctactacccctatttgtgagtatgatggaaatacggtctcaggttacaaaaaagtgatggcaacaattgactctttccagtccttcaatacaagcactatgcactttactgatgagaggatagaatggaaagaccctgatggaatgttgagggaccatataaatattttagtaacaaaggatattgatttcgataatcttggtgaaaacccctgtaaaattggcttgcagacatcttctattgaaggggcatggggttctggtgtaggctttacacttacatgcttggtatcattaacagagtgtcctacttttttgacctccattaaagcctgtgacaaagctatttgttatggtgcagaaagtgtaacattaacaagaggacaaaatacagtgaaggtatcagggaaaggtggtcatagtggttcaactttcaaatgttgccatggggaagactgttcacaaattgggctccatgctgctgcacctcaccttgataaagttaatgggatctctgaaatagaaaatagtaaagtatatgatgatggagcaccacaatgtggtataaaatgttggtttgtcaaatcaggggaatggatttcagggatatttagtggcaattggattgtgctcattgtcctctgtgtattcctactgttttcattggtcttacttagtatcctttgccctgtcaggaagcataaaaaatcatag

SEQ ID NO: 3345 - RNA, 3408 nt, synthetic construct
  misc_feature 1..3408: note = derived and/or modified CDS sequence (wt) from HTNV__D25532.1__GP
  source 1..3408: mol_type = other RNA
atggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaggcattctctgtcccgtaaggaagcataaaaaatcatag

SEQ ID NO: 3346 - RNA, 3408 nt, synthetic construct
  misc_feature 1..3408: note = derived and/or modified CDS sequence (wt) from HTNV__L08753.1__GP
  source 1..3408: mol_type = other RNA
atggggatatggaagtggctagtgatggccagtttagtatggccagcttacacactgagaaatgtgtatgacatgaaaattgaatgcccccatactgtaagttttggtgagaacagtgtgatagggtatgtggagttacctcctataccattagctgacacaacacaaatggtaccggaaagttcttgcagtatggacaaccaccagtcattgaatacagtaacaaaatatacccaagtaagttggagaggtaaggctgatcaggcacaggccagccagaactcatttgaagcagtgtctgctgaagttgacctcaaaggaacttgtgttttaaagcataaaatgttagaagagtcataccgcagcagaaaatcaatagcttgttatgacctctcttgtaatagtacctattgcaagcctaccctgtatatgattgtgccaatccatgcatgcaatatgatgaaaagttgtttaattgcactaggaccccacagggtccaagtggtctatgaaagaacctactgcatgacaggggttctgatagaaggaaaatgttttgtcccagaccaaagtgttgtaagcattattaagcatggtatctttgacattgcaagtgtccacattgtttgcttctttgtggcagttaaaggaaacacttacaagatttttgagcagataaaaaagtcatttgagtccacatacaatgatactaagaataaggtagagggatattacatctgcattgtagggggaaactctgcacctatatatgtgccaacacttgatgactttagatcaatggaagcattctcagggatctttagatcaccacatggggaggaccatgatttggctggagaagaaattgcttcatactctattgttggacctgccaatgtaaaagtacctcatagtgccagttcagacacattgagtctgactgcctattcaggtataccatcttattcctcacttagtatccttgcaggttcagcagaagctaagcatgtatttagtcctggattcttcccacagcttaatcatacaaaatgtgataagactgctataccattgatgtggacaggaatgattgacttgcctgggtattatgaggccatacatccttgtacagtcttctgtgttttatcaggcccaggggcatcatgtgaagcattttcagaaggtggcattttcaacataacatccccaatgtgtttagtctcaaaacagaaccgattccggctgacagaacagcaagtaaactttgtttgtcagagagttgatatggacattattgtgtattgtaatggtcagaggaaagtgatactaacaaaaaccttagttataggacagtgtatatataccataacaagtttgttctcactgttacctggggtagcacattctattgctgttgagttatgcgtccctgggtttcatgggtgggctacagctgctttgcttgttacattttgctttggctgggttctaataccagcaatgacatttattgtgctaacaattttgaaattcattgcaaatattttccatacaagtaaccaagagaataagcttaaatcagtactgaggaagataaaagaggaatttgaaaaaacaaaaggatcaatggtgtgtgatgtgtgtaaatatgagtgtgagacctacaaggagttgaaggcacatggggtttcatgtccccaatctcaatgcccatattgcttcactcattgtgaacctacagaagcagcattccaggctcattatagggtatgtcaagtcacccataggttcagagatgatttaaagaagactgtcactcctcaaaattttacacctggttgttatcggacgttaaaccttttcagatataaaagtagatgttacatttttacaatgtgggtcttcctcctggttttggagtccatactttgggctgctagtgcatcggaaatacccttataccctgtatggaatgacaacgcccatggagtaggttctgtaccgatgcacacagacttagagctggatttttctttaacatcaagttccaagtatacataccgtaggaaactaacaaatccgctagaagaatcacaggcaattaaccttcatattgaaatagaagaacagacaattggagttgatgtgcatgctttaggccattggtttgatggtcgtctcaatcttaagacatcctttcactgctatggtgcttgtacaaaatatgaatatccatggcatacagcaaagtgtcactatgatcgggattatcagtatgaaacaagttggggctgtaatccatctgactgccctggggtaggtacgggctgtacagcatgcggattgtaccttgaccaattaaagcctgttggtagtgcatacaaaattattacaataagatacagcagaagagtatgtgtccaatttggggaagaaaatctatgtaagatcatagacatgaatgactgttttgtatccagacatgtcaaggtatgcataattggtacagtctctaaattttcccagggtgacacgctattattctttggacctctcgagggtggcggcttaatattcaaacactggtgtacatctacctgccaatttggggaccctggagatatcatgagtccaagggacaaaggatttttatgccctgaattcccaggtagtttcaggaagaaatgcaacttcgctactacccctctctgtgaatatgatggaaatatggtatcagggtacaaaaaagtaatggcaacaattgattcctttcaatcctttaacactagtactatgcacttcactgatgagagaatagaatggaaagaccctgatggaatgttacgagaccacattaatattctagtaactaaggatattgactttgagaatcttggtgaaaatccctgtaaaattggcttacagacatcctcaattgagggggcatggggctctggtgttggcttcaccctcacatgtttagtatcattgacagagtgccctacctttttaacatcaattaaggcttgcgataaagccatctgctatggtgcagaaagtgtaacattaacaagaggccagaatacagtcaaagtgtcagggaagggtggttatagtggctcaacttttaaatgctgtcatggggaagaatgttcacagattggactccatgctgctgcacctcaccttgataaggttaatgggatttctgaaattgagaataataaagtttatgatgatggtgcaccccagtgtgggataaagtgctggtttgtaaaatctggagaatggatttcagggattttcagtgggaactggattgtgctcattgtcctctgtgtgtttttattgttttcattgatattactcagtattctttgccctgcaagaaagcacaaaaagtcatag

SEQ ID NO: 3347 - RNA, 3408 nt, synthetic construct
  misc_feature 1..3408: note = derived and/or modified CDS sequence (wt) from HTNV__M14627.1__GP
  source 1..3408: mol_type = other RNA
atggggatatggaagtggctagtgatggccagtttagtatggcctgttttgacactgagaaatgtctatgacatgaaaattgagtgcccccatacagtaagttttggggaaaacagtgtgataggttatgtagaattaccccccgtgccattggccgacacagcacagatggtgcctgagagttcttgtaacatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaagttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagcttgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctctcccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacagtgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaatcaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccattatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaggtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 3348 - RNA, 3408 nt, synthetic construct
  misc_feature 1..3408: note = derived and/or modified CDS sequence (wt) from HTNV__EU074672.1__GP
  source 1..3408: mol_type = other RNA
atggggatatggaagtggctagtaatggccagtttagtctggccagcctttgcactaaggaatgtgtatgacatgaaaattgagtgtccccacacagttagttttggagagaacagtgttataggatatgttgaactgcctcctatgccactggctgacacaacgcaaatggtgccggaaagctcttgcagcatggataatcaccaatcattaaacacaatcacaaaatacacccaaataatctggagaggaaaggctgatcaatcccaatccagccaaaattcatttgagacagtgtctactgaggttgaccttaaaggaacctgtgtattaaaacacaagatgatagaagaatcataccgcagtcggaagtcaataacttgttatgatctgtcctgcaacagcacctattgcaaaccaactctgtacatgatcgtaccaatccatgcatgtaatatgatgaagagctgtttaattgcactaggaccttatagggtccaggttgtttatgaaagaacctattgcatgacaggggttttaattgaagggaaatgctttgttcctgaccagagtgtagttagtatcattaaacatgggatcttcgatattgcaagtgtccacattgtttgcttctttgttgcagtcaaaggaaacacatacaagatctttgaacaggttaaaaagtcatttgaatctaattgtaatgacactgaaaataaagtgcaagggtactacatttgtattatagggggaaattcctcacccgtatatgtaccaacactggatgattttaggtcaatggaagcattctcaggaatttttagatcaccacatggagaagaccatgatctagctggagaagaggttgcatcatattctattgttggacctgctaatgctaaggtgccccatagtgccagctcagacacattaggcttaattgcttattctggtataccatcttattcttctctcagcatcctcacaagctcaacagaagcaaagcatgtgttcagccctggattattcccccagctaaaccatacaaagtgtgacaaaactgctataccattgacatggacagggatgattgaccttcctggatactatgaagctatacatccttgcacagttttctgtgtcttgtcaggtcccggggcttcatgtgaggctttttctgaaggtggaatcttcaatataacttctccaatgtgtctagtgtcaaagcagaatcgttttagactaacagaacaacaggtgaattttgtatgccagagggttgatgttgacattattgtctattgtaatggtcagagaaaagtaatattaacaaagactctggttattgggcaatgtatatatactataacgagcctattctcactattacctggggtagcacattcaattgcagttgaactgtgtgttcctgggttccatgggtgggccacagctgcattacttgttacattttgctttggttgggttctcatcccagcaatcacattcattatattgacaattttaaagttcattgcaaatatcttccacacaagcaatcaggagaataggttaaagtcagtactcagaaagataaaggaagaatttgaaaggacaaaaggatcaatggtgtgtgatatatgtaaatatgagtgtgagacttatagagaactaaaggcacatggggtctcatgcccacaatcccaatgcccttattgtttcacccactgtgagcccacagaagctgcatttcaggcccattataaagtgtgtcaagttactcatagatttagggatgatttaaagaagacagttactccccagaactttacacctggttgctatcgaacattgaatttattcagatataagagtaggtgttatatttttacaatgtgggtttttcttttagtcttagaatcaatcttatgggcagccagtgcatcagaaatacctttaaatccagtatggaacgacaatgcccatggggtgggttctatcccaatgcatacagacttggaattggacttttccttgacatcaagctcaaagtacacctaccgaaggaaactaacaaacccacttgaagaatctcaggcaattgacctccatgtagaaatagaagagcaaacaattggtgtagatgtgcatgcattgggtcattggtttgatggccgccttaatcttaagacatcctttcactgttacggtgcatgcaccaagtatgagtacccatggcatactgcaaaatgccactatgaaagggattaccaatatgagacaagttggggttgtaacccttcagactgtcctggtgtaggtacaggctgtactgcatgtgggttatatcttgatcagttgaaacctgttggaagtgcttacaaaatcattacaatacgatatagcagaagagtttgtgttcaatttggagaggaaaatctctgtaaaattatagatatgaatgattgctttgtttctaggcatgttaaagtctgtataatcggcacagtttctaaattttctcaaggtgatacactcctattctttggaccacttgaaggtggtggtctaatatttaaacattggtgcacatcaacatgccagtttggggacccaggagatattatgagtccaagagataagggatttttatgccctgagttcccaggtagctttagaaagaagtgtaattttgccacaacccctgtttgtgaatatgatgggaatatggtttcaggttataaaaaagtaatggccacaattgattcttttcaatccttcaatacaagcactatgcatttcactgatgagaggatagaatggaaagaccctgatgggatgttaagggaccatattaacattctggttacaaaggatattgactttgataatcttggtgaaaatccctgcaagattggattacaaacatcctccattgaaggggcatgggggtctggtgtaggctttacacttacatgtttgatatcactgacagaatgctctacattcttgacctcaatcaaagcttgtgacaaggcaatctgttatggtgcagagagtgtgacacttacaagaggtcaaaatacagtgaaagtgtcaggaaagggcggacatagcggctcatccttcaaatgctgtcatggggaagaatgctcacagataggactccatgctgctgcacctcatcttgacaaggttaacgggatttcagagatggagaacagtaaagtgtttgatgatggggcaccacagtgtgggataaaatgctggtttgttaaatcaggggaatggatttctgggattttcagcggtaattggattgtacttattgttctatgtgtatttctactattctcattggtattgcttagtattctctgtcctgtcagaaagcataaaaagtcatag

SEQ ID NO: 3349 - RNA, 3408 nt, synthetic construct
  misc_feature 1..3408: note = derived and/or modified CDS sequence (wt) from HTNV__GQ120966.1__GP
  source 1..3408: mol_type = other RNA
atggagatatggaagtggctagtaatggccagtttagtatggccagcttttacactgagaaatgtgtatgacatgaaaattgagtgcccccacacagttagctttggtgaaaacagtgtgataggttatgtggaattaccccctatgccattggctgacacagcacaaatggtaccagaaagctcttgtaacatggacaatcaccaatcaatgaatacaataacaaaatacacccaggtaagttggagaggtaaggctgatcaggcacaagccagccagaattcatttgaagcagtgtctgctgaagttgatcttaaaggaacctgtgttctaaagcacaaaatgttagaagaatcataccgcagcagaaaatcaatcacttgttatgacctttcctgcaacagcacctactgtaagcccaccctgtatatgattgtaccaattcatgcgtgtaacatgatgaaaagttgcctaattgcactggggccttacagagtgcaagtagtttatgaaagaacctactgtatgaccggggtcctgatagaaggaaaatgttttgttccagaccaaagtgtagtcagcatcatcaagcatgggatcttcgatatagcaagtgttcatattgtttgtttctttgtggcagttaaaggaaacacatacaaactttttgaacaggtcaaaaagtcatttcaatccacatgcaatggtactgaaaataaagtacaaggatattatatctgcattgtaggaggaaactctgcacctatatatgtgccaacacttgatgattttagatccatggaggcattctcagggatttttaggtcaccacatggagaggaccatgatctagctggagaagagattgcctcttactctattgttggacctgccaatgcaaaagtgcctcacagtgctagctcagacacattaagcttaattgcctattctggtataccatcctactcttcacttagcatccttgcaagctcaacagaagctaagcatgtatttagccctggcttctttccacagcttaaccatacaaagtgtgataaaactgccatcccacttacttggacagggatgattgacttacctggatactatgaagctatacatccttgtacagtcttttgtgtattatcaggccccggggcatcatgtgaagcattttctgaaggtggaattttcaacataacatcccctatgtgcttagtgtcaaagcaaaatcgattccggttaacagaacagcaagtaaactttgtttgtcaaagagttgatatggacattattgtgtactgtaatggccagaggaaagtgatattgacaaaaaccttagtcataggacagtgcatatatactataacaagtttattctcactgctacctggggtagcacattccattgctgttgaattgtgtgtgcctgggttccatggttgggctacagctgccctccttgttacattctgctttgggtgggttcttataccagcactaacactcattatcttaacaattttaaagtttattgcaaatatcttccacacaagtaatcaagagaataggcttaaatcagtattaaggaaaatcaaggaagaatttgagaagacaaaagggtcaatggtgtgtgatgtctgcaaatacgagtgtgaaacttataaagaactgaaggcacatggggtttcatgccctcagtctcaatgtccatactgcttcactcattgtgaacctacagaagcagcatttcaggcccattatagagtgtgtcaagtcacccacagattcagggatgacttgaagaagactgttactcctcaaaactttacacctggttgctatcggacactgaacctgttcagatataaaagtagatgttatatctttacaatgtgggtctgcctcctggtcttggagtcaatactatgggctgccagtgcttcagaagtgcccttaaatcctgtatggaatgataatgcccatggggtagggtctgtaccgatgcatactgacttagagctcgactttcccctaacatcaagctcaaagtatacataccgcagaaggctgacaaatccacttgaagaaacacaatcaattaaccttcacattgaaatagaagaacaaacaattggtgttgatgtgcatgcattgggccactggtttgatggtcggctcaaccttaaaacatctttccattgttatggcgcctgtacaaaatatgagtatccctggcacactgcaaagtgtcactatgaacgggattaccagtacgagacaagttggggctgtaacccagctgattgcccaggggtagggacaggttgcacagcatgtggattatatcttgatcaattgaagccagttggtagtgcatataaaatcatcacaataagatatagcaggaaagtgtgtgttcaatttggggaggaaaacctatgtaaggtaatagacatgaatgattgctttgtcactagacacgttaaagtatgcataattggcacagtctctaaattttcccaaggtgatacattattgttcttcggaccacttgagggtggcgggttgatatttaaacactggtgcacatccacatgccagtttggagaccctggagatatcatgagtcccagggataagggatttttatgccctgaatttcctggaagttttaggaagaagtgtaattttgccactactcctctttgtgagtatgatggcaatatggtctcagggtataagaaggtaatggcaacaattgattcttttcaatcctttaacactagtactatgcactttactgatgaaagaatagagtggaaagacccagatgggatgttaagggatcatataaacattctggtgactaaggacattgattttgataatctcggtgaaaacccctgtaaaattggattacagacatcctcaattgaaggggcctggggttctggtgtaggctttacactcacatgtctaatatctttaacagagtgtcccacgttcctgacctcaattaaggcttgtgacaaagccatttgttatggtgcagaaagtgtaacattaacaagaggtcagaacacagttaaggtgtcaggtaaaggtggccacagcggttcaacttttaaatgctgtcatggagaagaatgttcacaaattggactccatgctgctgcacctcaccttgataaagtcaatgggatttcagaaattgagaataataaagtatatgatgatggggcaccccaatgtggggtaaagtgctggtttgtaaaatccggagaatggatctcagggatttttagtggaaattggattgtactcattgttctttgtgtattcttgttgttttcactggtgttactcagtgtcctttgtcctgtaagaaagcacaaaaaatcataa

SEQ ID NO: 3350 - RNA, 3408 nt, synthetic construct
  misc_feature 1..3408: note = derived and/or modified CDS sequence (wt) from HTNV(CGAa1011)__EF990927.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagatacaatacaaatggtgcctgaaagttcttgtagcatggacaaccaccagtccttgagcacagtaacaaagtatacacaagtgagttggagagggaaagctgaccaggcacagtctaaccagacttcatttgagacagtgtctgttgaagttgatcttaaggggacctgtgtattaaaacacaaattggtagaagaatcataccgtagccggaagtcactaacttgttatgacctctcttgtaacagtacctactgcaagccaacactgtacatgatcgtaccaatccatgcatgcaacatgatgaagagctgcataattgcactagggccgcatagagtacaagtggtatacgagagaacatattgcatgactggggttctattagaagggaagtgttttgtcccagatcagagtgtagtcggcattgtcaagcacggtatctttgacattgcaagtgttcatattgcatgtttttttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacgctaagtctaattgctttttcaggaataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgttttatcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccataacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatttttcacacaagtaatcaagagaataggctaaaaatggtcttgaaaaaaatcaaggaagagtttgaaaggacaaagggatcaatggtatgtgatatctgtaaatatgagtgtgaaacctacaaagagttgaaggcacatggagtttcatgtcctcaatctcaatgcccttattgttttacccactgtgaacctacagaatcagcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtccttgagtcaatcctgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaagcaattggtgttgacgttcatgcattgggacactggtttgatggtcgtttaaatctcaagacatcctttcattgttacggtgcatgcacaaaatatgaatacccatggcatactgcaaagtgccactatgaaagggattatcaatatgagacgagctggggttgtaacccatcagattgcccaggggtgggtacaggatgtacagcatgtgggttatatctagaccagttaaaaccagttggcagtgcatacaaaattattacaataaggtatagtaggagagtttgtgttcaatttggtgaagaaaatctttgcaaagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatgatggaaatatggtctcaggatataagaaagtaatggctacaattgattcatttcaatcctccaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgccgcacctcatcttgataaggtcaatgggatctctgaaatagaaaatagtaaagtatatgatgatggagcaccacagtgtggggttaaatgttggtttgtcaaatctggagagtggatctcagggattttcagtggtaactggattgtcctcattgtcctctgtgtgtttctactattttcattggtgttgcttagcatcctatgtcctgttagaaaacacaaaaaatcataa

SEQ ID NO: 3351 - RNA, 3408 nt, synthetic construct
  misc_feature 1..3408: note = derived and/or modified CDS sequence (wt) from HTNV(CGAa2)__EU092223.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagatacaatacaaatggtgcctgaaagttcttgtagcatggacaaccaccagtccttgagcacagtaacaaagtatacacaagtgagttggagagggaaagctgaccaggcacagcctagccagacttcatttgagacagtgtctgttgaagttgatcttaaggggacctgtgtattaaaacacaaattggtagaagaatcataccgtagccggaagtcactaacttgttatgacctctcttgtaacagtacctactgcaagccaacactgtacatgatcgtaccaatccatgcatgcaacatgatgaagagctgcataattgcactagggccgcatagagtacaagtggtatacgagagaacatattgcatgactggggttctattagaagggaagtgttttgtcccagatcagagtgtagtcagcattgtcaggcacggtatctttgacattgcaagtgttcatattgcatgtttttttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacactaagtctaattgctttttcaggaataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgttttatcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccataacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatttttcacacaagtaatcaagagaataggctaaaaatggtcttgaaaaaaatcaaggaagagtttgaaaggacaaagggatcaatggtatgtgatatctgtaaatatgagtgtgaaacctacaaagagttgaaggcacatggagtttcatgtcctcaatctcaatgcccttattgttttacccactgtgaacctacagaatcagcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtccttgagtcaatcctgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaggcaattggtgttgacgttcatgcattgggacactggtctgatggtcgtttaaatctcaagacatcctttcattgttacggtgcatgcacaaaatatgaatacccatggcatactgcaaagtgccactatgaaagggattatcaatatgagacaagttggggttgtaacccatcagattgcccaggggtgggtacaggatgtacagcatgtgggttatatctagaccagttaaaaccagttggcagtgcatacaaaattattacaataaggtatagtaggagagtttgtgttcaatttggtgaagaaaatctttgcaaagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatgatggaaatatggtctcaggatataagaaagtaatggctacaattgattcatttcaatcctccaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgccgcacctcatcttgataaggtcaatgggatctctgaaatagaaaatagtaaagtatatgatgatggagcaccacagtgtggggttaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3352 - RNA, 3408 nt, synthetic construct
  misc_feature 1..3408: note = derived and/or modified CDS sequence (wt) from HTNV(CGAa31MP7)__EF990925.1__GP
  source 1..3408: mol_type = other RNA
atggggatatggaagtggctagtaatggccagtttagtctggccagcctttgcactaaggaatgtgtatgacatgaaaattgagtgtccccacacagttagttttggagagaacagtgttataggatatgttgaactgcctcctatgccactggctgacacaacgcaaatggtgccggaaagctcttgcagcatggataatcaccaatcattaaacacaatcacaaaatacacccaaataatctggagaggaaaggctgatcaatcccaatccagccaaaattcatttgagacagtgtctactggggttgaccttaaaggaacctgtgtattaaaacacaagatgatagaagaatcataccgcagtcggaagtcaataacttgttatgatctgtcctgcaacagcacctattgcaaaccaactctgtacatgatcgtaccaatccatgcatgtaatatgatgaagagctgtttaattgcactaggaccttatagggtccaggttgtttatgaaagaacctattgcatgacaggggttttaattgaagggaaatgctttgttcctgaccagagtgtagttagtatcattaaacatgggatcttcgatattgcaagtgtccacattgtttgcttttttgttgcagtcaaaggaaacacatacaagatctttgaacaggttaaaaagtcatttgaatctaattgtaatgacactgaaaataaagtgcaagggtactacatttgtattatagggggaaattcctcacccgtatatgtaccaacactggatgattttaggtcaatggaagcattctcaggaatttttagatcaccacatggagaagaccatgatctagctggagaagaggttgcatcatattctattgttggacctgctaatgctaaggtgccccatagtgccagctcagacacattaggcttaattgcttattctggtataccatcttattcttctctcagcatcctcacaagctcaacagaagcaaagcatgtgttcagccctggattattcccccagctaaaccatacaaagtgtgacaaaactgctataccattgacatggacagggatgattgaccttcctggatactatgaagctatacatccttgcacagttttctgtgtcttgtcaggtcccggggcttcatgtgaggctttttctgaaggtggaatcttcaatataacttctccaatgtgtctagtgtcaaagcagaatcgttttagactaacagaacaacaggtgaattttgtatgccagagggttgatgttgacattattgtctattgtaatggtcagagaaaagtaatattaacaaagactctggttattgggcaatgtatatatactataacgagcctattctcactattacctggggtagcacattcaattgcagttgaactgtgtgttcctgggttccatgggtgggccacagctgcattacttgttacattttgctttggttgggttctcatcccagcaatcacattcattatattgacaattttaaagttcattgcaaatatcttccacacaagcaatcaggagaataggttaaagtcagtactcagaaagataaaggaagaatttgaaaggacaaaaggatcaatggtgtgtgatatatgtaaatatgagtgtgagacttataaagaactaaaggcacatggggtctcatgcccacaatcccaatgcccttattgtttcacccactgtgagcccacagaagctgcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtcctagaatcaatcttatgggcagccagtgcatcagaaatacctttaaatccagtatggaacgacaatgcccatggggtgggttctatcccaatgcatacagacttggaattggacttttccttgacatcaagctcaaagcacacctaccgaaggaaactaacaaacccacttgaagaatctcaggcaattgacctccatgtagaaatagaagagcaaacaattggtgtagatgtgcatgcattgggtcattggtttgatggccgccttaatcttaagacatcctttcactgttacggtgcatgcaccaagtatgagtacccatggcatactgcaaaatgccactatgaaagggattaccaatatgagacaagttggggttgtaacccttcagactgtcctggggtcggcacaggctgtacagcatgtgggttatatctagaccagttaaaaccagttggcagtgcatacaaaattattacaataaggtatagtaggagagtttgtgttcaatttggtgaagaaaatctttgcaaagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccaggagatatcatgagcccaagagataaaggttttttatgtcctgaatttccaggcagttttaggaaaaaatgcaactttgccactacccctgtttgtggatatgatggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacctcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3353 - RNA, 3408 nt, synthetic construct
  misc_feature 1..3408: note = derived and/or modified CDS sequence (wt) from HTNV(CGAa4MP9)__EF990929.1__GP
  source 1..3408: mol_type = other RNA
atggagatatggaagtggcttgtgatggccagtttagtatggcctgccttagcactgaggaatgtctatgacatgaaaattgagtgcccccacacagtcagttttggagaaaatagcgtacttggttatgtggaattgcctcctatgccattggcagacacaatacaaatggttcctgaaagttcttgtagcatggacaaccaccagtccatgagcacagcaacgaagtatactcaagtgagctggagagggaaagctgaccaggcacagtctagccagacttcatttgaaacagtgtctgttgaagttgatcttaaggggacctgtgtattaaaacacaaaatggtagaaaagtcataccgtagcagaaagtcactaacttgttatgacctctcttgtaacagtacctactgtaaaccaacactgtatatgattgtgccaatccatgcatgtaacatgatgaaaagttgcatcattgcactagggccttatagagtacaagtggtttacgagaggacatattgcatgacaggggtcctattagaagggaaatgttttgtcccagatcagagtgtagtcagcattgtcaagcacagcatctttgacattgcaagtgttcatattgcatgtttttttgtagcaattacaggaaacacatataagcttattgaacaagttaagacgtcatttgggacaacatgtaacgatactgaagacaaggtgcaaggctattacatctgtattcttggaggaaactctccacctatttatgtcccaacacttgatgattttaggtccatggaggcattctcaggaatattcagatcaccacatggagaagatcatgacctagctggggaagaaattgcttcatactctattgttggacctgctaatgcaaagatcccccatagtgccagctcagatacactaagtctaattgctttttcaggaataccatcttactcttctcttagtatcctcaccagttcaacagaggctaagcatgtatttagccctggattatttccacagcttaatcatacaaaatgtgataagactgctataccattaacatggactggaataattgacttgcctggatattatgaggctgtacatccttgcacagttttctgtgttttgtcaggtccaggtgcatcatgtgaggcattttcagaaggtggaattttcaacataacctcacctatgtgcctagtatcaaagcaaaacaggtttcgactaacagaacagcaagtcaactttgtatgccaaagagttgacatggatatcgtggtttattgtaatggtcaaaggaaggtgatattaacaaaaaccttagttattggacaatgtatatatactataacaagtttattctcactgctacctggggtagcacactctattgctgttgagctgtgtgtacctgggtttcatgggtgggctacagctgctttacttgtcacattttgtttcgggtgggttctcataccggcaattacatttgttgtacttactgtattgaagttcattgcaaatatctttcatacaagtaatcaagagaataggctaaaaatggtcttaaagaaaatcaaggaagagtttgaaaagacaaagggctcaatggtttgtgatatctgtaaatatgagtgtgagacctacaaagagttgaaggcacatggggtttcatgtcctcaatcccaatgtccttattgttttacccactgtgaacccacagaatcagcattccaggcccattatagagtatgtcaagttactcatcggttcagagaagacctaaagaagactgttactcctcagaacttcacacctgggtgttatcgtacattgaatttatttagatataaaagtaggtgttacattttcacaatgtggatctttcttttagtccttgagtcaatcctatgggctgcaagtgcgtcagaaacacccttaagccctacatggaatgataatgcccacggggttgggtccatacccatgcacacagatttagagctagacttttctctaacatcaagttctaagtatacatacaggaggaagctaacaaatccacttgaagaagcacaggcagtcagtttccatgttgaaatagaagagcaaacaatcggtgttgatgttcatgcattagggcattggtttgatggtcgtttgaatctcaaaacatcctttcattgttacggtgcatgtacaaagtatgaatacccatggcatactgcaaagtgccattatgaaagggattatcagtatgagacaagttggggttgtaacccatcagattgcccaggagtgggtacaggatgcacagcatgtgggttatatctcgaccagttaaaaccggttggcagtgcatataaaatcattacaataaggtatagtaggagagtttgtgttcaatttggtgaagagaacctttgtaaagtcatagatatggatgattgttttgtgtctagacatgtcaaggtttgtataattggcacagtttctaaattctcccaaggtgatacattattgttctttggaccacttgaaggcggtggcttaatttataaacattggtgcacatctacatgccagtttggagaccctggagatatcatgagcccaagagacaaaggtttattatgtcctgaatttccaggcagttttaggaaaaaatgcaactttgccactacccccgtttgtgaatatgatggaaatatggtctcaggttataagaaagtaatggctacaattgattcatttcaatccatcaatactagcaccatgcatttcactgatgagagaatagaatggaaagatcctgatgggatgttaagggaccacatcaatattttagtaacaaaagatattgattttgacaatcttggtgaaaacccttgtaagattggcttacagacatcctccatcgaaggcgcatggggctcaggtgtaggcttcacactcacatgcttaatatcattaacagagtgccctactttcttaacatcaatcaaggcctgtgacaaagctatatgctatggtgcagagagcgtgacattaacaagagggcaaaatacagtcaaagtatcagggaagggtgggcatagtggctcaacattcaaatgctgtcatggagaagactgttcacagagtgggctccatgctgctgcacctcaccttgataaggtcaatgggatctctgaaatggaaaatagtaaagtatatgatgatggagcaccacaatgtgggatcaaatgttggtttgtcaaatctggagagtggatctcaggaatcttcagtggtaactggattgtcctcattgtcctctgtgtatttctactattttcattggtattgcttagcatcctctgtcctgtcagaaaacacaaaaaatcataa

SEQ ID NO: 3354 - RNA, 3408 nt, synthetic construct
  misc_feature 1..3408: note = derived and/or modified CDS sequence (wt) from HTNV(CGAa4P15)__EF990928.1__GP
  source 1..3408: mol_type = other RNA
atggagatatggaagtggcttgtgatggccagtttagtatggcctgccttagcactgaggaatgtctatgacatgaaaattgagtgcccccacacagtcagttttggagaaaatagcgtacttggttatgtggaattgcctcctatgccattggcagacacaatacaaatggttcctgaaagttcttgtagcatggacaaccaccagtccatgagcacagcaacgaagtatactcaagtgagctggagagggaaagctgaccaggcacagtctagccagacttcatttgaaacagtgtctgttgaagttgatcttaaggggacctgtgtattaaaacacaaaatggtagaaaagtcataccgtagcagaaagtcactaacttgttatgacctctcttgtaacagtacctactgtaaaccaacactgtatatgattgtgccaatccatgcatgtaacatgatgaaaagttgcatcattgcactagggccttatagagtacaagtggtttacgagaggacatattgcatgacaggggtcctattagaagggaaatgttttgtcccagatcagagtgtagtcagcattgtcaagcacagcatctttgacattgcaagtgttcatattgcatgtttttttgtagcaattacaggaaacacatataagctttttgaacaagttaagacgtcatttgggacaacatgtaacgatactgaagacaaggtgcaaggctattacatctgtattcttggaggaaactctccacctatttatgtcccaacacttgatgattttaggtccatggaggcattctcaggaatattcagatcaccacatggagaagatcatgacctagctggggaagaaattgcttcatactctattgttggacctgctaatgcaaagatcccccatagtgccagctcagatacactaagtctaattgctttttcaggaataccatcttactcttctcttagtatcctcaccagttcaacagaggctaagcatgtatttagccctggattatttccacagcttaatcatacaaaatgtgataagactgctataccattaacatggactggaataattgacttgcctggatattatgaggctgtacatccttgcacagttttctgtgttttgtcaggtccaggtgcatcatgtgaggcattttcagaaggtggaattttcaacataacctcacctatgtgcctagtatcaaagcaaaacaggtttcgactaacagaacagcaagtcaactttgtatgccaaagagttgacatggatatcgtggtttattgtaatggtcaaaggaaggtgatattaacaaaaaccttagttattggacaatgtatatatactataacaagtttattctcactgctacctggggtagcacactctattgctgttgagctgtgtgtacctgggtttcatgggtgggctacagctgctttacttgtcacattttgtttcgggtgggttctcataccggcaattacatttgttgtacttactgtattgaagttcattgcaaatatctttcatacaagtaatcaagagaataggctaaaaatggtcttaaagaaaatcaaggaagagtttgaaaagacaaagggctcaatggtttgtgatatctgtaaatatgagtgtgagacctacaaagagttgaaggcacatggggtttcatgtcctcaatcccaatgtccttattgttttacccactgtgaacccacagaatcagcattccaggcccattatagagtatgtcaagttactcatcggttcagagaagacctaaagaagactgttactcctcagaacttcacacctgggtgttatcgtacattgaatttatttagatataaaagtaggtgttacattttcacaatgtggatctttcttttagtccttgagtcaatcctatgggctgcaagtgcgtcagaaacacccttaagccctacatggaatgataatgcccacggggttgggtccatacccatgcacacagatttagagctagacttttctctaacatcaagttctaagtatacatacaggaggaagctaacaaatccacttgaagaagcacaggcagtcagtttccatgttgaaatagaagagcaaacaatcggtgttgatgttcatgcattagggcattggtttgatggtcgtttgaatctcaaaacatcctttcattgttacggtgcatgtacaaagtatgaatacccatggcatactgcaaagtgccattatgaaagggattatcagtatgagacaagttggggttgtaacccatcagattgcccaggagtgggtacaggatgcacagcatgtgggttatatctcgaccagttaaaaccggttggcagtgcatataaaatcattacaataaggtatagtaggagagtttgtgttcaatttggtgaagagaacctttgtaaagtcatagatatggatgattgttttgtgtctagacatgtcaaggtttgtataattggcacagtttctaaattctcccaaggtgatacattattgttctttggaccacttgaaggcggtggcttaatttttaaacattggtgcacatctacatgccagtttggagaccctggagatatcatgagcccaagagacaaaggttttttatgtcctgaatttccaggcagttttaggaaaaaatgcaactttgccactacccccgtttgtgaatatgatggaaatatggtctcaggttataagaaagtaatggctacaattgattcatttcaatccatcaatactagcaccatgcatttcactgatgagagaatagaatggaaagatcctgatgggatgttaagggaccacatcaatattttagtaacaaaagatattgattttgacaatcttggtgaaaacccttgtaagattggcttacagacatcctccatcgaaggggcatggggctcaggtgtaggcttcacactcacatgcttaatatcattaacagagtgccctactttcttaacatcaatcaaggcctgtgacaaagctatatgctatggtgcagagagcgtgacattaacaagagggcaaaatacagtcaaagtatcagggaagggtgggcatagtggctcaacattcaaatgctgtcatggagaagactgttcacagagtgggctccatgctgctgcacctcaccttgataaggtcaatgggatctctgaaatggaaaatagtaaagtatatgatgatggagcaccacaatgtgggatcaaatgttggtttgtcaaatctggagagtggatctcaggaatcttcagtggtaactggattgtcctcattgtcctctgtgtatttctactattttcattggtattgcttagcatcctctgtcctgtcagaaaacacaaaaaatcataa

SEQ ID NO: 3355 - RNA, 3408 nt, synthetic construct
  misc_feature 1..3408: note = derived and/or modified CDS sequence (wt) from HTNV(CGAa75)__EU092224.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagatacaatacaaatggtgcctgaaagttcttgtagcatggacaaccaccagtccttgagcacagtgacaaagcatacacaagtgagttggagagggaaagctgaccaggcacagtctagccagacttcatttgagacagtgtctgttgaagttgatcttaaggggacctgtgtattaaaacacaaattggtagaagaatcataccgtagccggaagtcactaacttgttatgacctctcttgtaacagtacctactgcaagccaacactgtacatgatcgtaccaatccatgcatgcaacatgatgaagagctgcataattgcactagggccgcatagagtacaagtggtatacgagagaacatattgcatgactggggttctattagaagggaagtgttttgtcccagatcagagtgtagtcagcattgtcaggcacggtatctttgacattgcaagtgttcatattgcatgtttctttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacactaagtctaattgctttttcaggaataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgtcttgtcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccataacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatctttcacacaagtaatcaagagaataggctaaaaatggtcttgaaaaaaatcaaggaagagtttgaaaggacaaagggatcaatggtatgtgatatctgtaaatatgagtgtgaaaccaacaaagagttgaaggcacatggagtttcatgtcctcaatctcaatgcccttattgctttacccactgtgaacctacagaatcagcatctcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtccttgagtcaatcctgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaggcaattggtgttgacgttcatgcattgggacactggtttgatggtcgtttaaatctcaagacatcctttcattgttacggtgcatgcacaaaatatgaatacccatggcatactgcaaagtgccactatgaaagggattatcaatatgagacaagttggggttgtaacccatcagattgcccaggggtcggcacaggctgtacagcatgtgggttatatctagaccagttaaaaccagttggcagtgcatacaaaattattacaataaggtatagtaggagagtttgtgttcaatttggtgaagaaaatctttgcatagtcatagatatgaatgattgttttgtgtctagacatgtcaaggtctgtataattggtacagtttctaaattctcccaaggtgacacattattgttctttgggccgcttgaaggtggtggtttaattctcaaacattggtgcacatctacatgccagtttggagacccgggagatatcatgagcccaagagataaaggttttttatgtcctgaatttccaggcagttttaggaaaaaatgcaactttgccactacccctgtttgtgaatatggtggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgttcctactattttcattggtgttgcttagcatcctttgtcctgttagaaaacacaaagaatcataa

SEQ ID NO: 3356 - RNA, 3408 nt, synthetic construct
  misc_feature 1..3408: note = derived and/or modified CDS sequence (wt) from HTNV(CGHu2)__EU363819.1__GP
  source 1..3408: mol_type = other RNA
atggggatatggaagtggctagtaatggccagtttagtctggccagcctttgcactaaggaatgtgtatgacatgaaaattgagtgtccccacacagttagttttggagagaacagtgttataggatatgttgaactgcctcctatgccactggctgacacaacgcaaatggtgccggaaagctcttgcagcatggataatcaccaatcattaaacacaatcacaaaatacacccaaataatctggagaggaaaggctgatcaatcccaatccagccaaaattcatttgagacagtgtctactggggttgaccttaaaggaacctgtgtattaaaacacaagatgatagaagaatcataccgcagtcggaagtcaataacttgttatgatctgtcctgcaacagcacctattgcaaaccaactctgtacatgatcgtaccaatccatgcatgtaatatgatgaagagctgtttaattgcactaggaccttatagggtccaggttgtttatgaaagaacctattgcatgacaggggttttaattgaagggaaatgctttgttcctgaccagagtgtagttagtatcattaaacatgggatcttcgatattgcaagtgtccacattgtttgcttttatgttgcagtcaaaggaaacacatacaagatctttgaacaggttaaaaagtcatttgaatctaattgtaatgacactgaaaataaagtgcaagggtactacatttgtattatagggggaaattcctcacccgtatatgtaccaacactggatgattttaggtcaatggaagcattctcaggaattattagatcaccacatggagaagaccatgatctagctggagaagaggttgcatcatattctattgttggacctgctaatgctaaggtgccccatagtgccagctcagacacattaggcttaattgcttattctggtataccatcttattcttctctcagcatcctcacaagctcaacagaagcaaagcatgtgttcagccctggattattcccccagctaaaccatacaaagtgtgacaaaactgctataccattgacatggacagggatgattgaccttcctggatactatgaagctatacatccttgcacagttatctgtgtcttgtcaggtcccggcgcttcatgtgaggctttatctgaaggtggaatcttcaatataacttctccaatgtgtctagtgtcaaagcagaatcgttttagactaacagaacaacaggtgaattttgtatgccagagggttgatgttgacattattgtctattgtaatggtcagagaaaagtaatattaacaaagactctggttattgggcaatgtatatatactataacgagcctattctcactattacctggggtagcacattcaattgcagttgaactgtgtgttcctgggttccatgggtgggccacagctgcattacttgttacattttgctttggttgggttctcatcccagcaatcacattcattatattgacaattttaaagttcattgcaaatatcttccacacaagcaatcaggagaataggttaaagtcagtactcagaaagataaaggaagaatttgaaaggacaaaaggatcaatggtgtgtgatatatgtaaatatgagtgtgagacttataaagaactaaaggcacatggggtctcatgcccacaatcccaatgcccttattgtttcacccactgtgagcccacagaagctgcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtcctagaatcaatcttatgggcagccagtgcatcagaaatacctttaaatccagtatggaacgacaatgcccatggggtgggttctatcccaatgcatacagacttggaattggacttttccttgacatcaagctcaaagcacacctaccgaaggaaactaacaaacccacttgaagaatctcaggcaattgacctccatgtagaaatagaagagcaaacaattggtgtagatgtgcatgcattgggtcattggtttgatggccgccttaatcttaagacatcctttcactgttacggtgcatgcaccaagtatgagtacccatggcatactgcaaaatgccactatgaaagggattaccaatatgagacaagttggggttgtaacccttcagactgtcctggggtcggcacaggctgtacagcatgtgggttatatctagaccagttaaaaccagttggcagtgcatacaaaattattacaataaggtatagtaggagagtttgtgttcaatttggtgaagaaaatctttgcaaagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccaggagatatcatgagcccaagagataaaggttttttatgtcctgaatttccaggcagttttaggaaaaaatgcaactttgccactacccctgtttgtggatatgatggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacctcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3357 - RNA, 3408 nt, synthetic construct
  misc_feature 1..3408: note = derived and/or modified CDS sequence (wt) from HTNV(CGHu3)__EU363818.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagacacaatacaaatggtgcctgaaagttcttgtagcatggacaaccaccagtccttgagcacagcaacaaagtatacacaagtgagttggagagggaaagctgaccaggcacagtctagccagacttcatttgagacagtgtctgttgaagttgatcttaaggggacctgtgtattaaaacacaaattggtagaagaatcataccgtagccggaagtcactaacttgttatgacctctcttgtaacagtacctactgcaagccaacactgtacatgatcgtaccaatccatgcatgcaacatgatgaagagctgcataattgcactagggccgcatagagtacaagtggtatacgagagaacatattgcatgactggggttctattagaagggaagtgttttgtcccagatcagagtgtagtcagcattgtcaggcacggtatctttgacattgcaagtgttcatattgcatgtttttttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacactaagtctaattgctttttcaggaataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgttttatcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccctaacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatttttcacacaagtaatcaagagaataggctaaaaatggtcttgaaaaaaatcaaggaagagtttgaaaggacaaagggatcaatggtatgtgatatctgtaaatatgagtgtgaaacctacaaagagttgaaggcacatggagtttcatgtcctcaatctcaatgcccttattgttttacccactgtgaacctacagaatcagcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtccttgagtcaatcctgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaggcaattggtgttgacgttcatgcattgggacactggtttgatggtcgtttaaatctcaagacatcctttcattgttacggtgcatgcacaaaatatgaatacccatggcatactgcaaagtgccactatgaaagggattatcaatatgagacaagttggggttgtaacccatcagattgcccaggggtgggtacaggatgtacagcatgtgggttatatctagaccagttaaaaccagttggcagtgcatacaaaattattacaataaggtatagtaggagagtttgtgttcaatttggtgaagaaaatctttgcaaagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatgatggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaaggttggcttacggacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3358 - RNA, 3408 nt, synthetic construct
  misc_feature 1..3408: note = derived and/or modified CDS sequence (wt) from HTNV(CGHu3612)__EF990923.1__GP
  source 1..3408: mol_type = other RNA
atggggatatggaagtggctagtaatggccagtttagtctggccagcctttgcactaaggaatctgtatgacatgaaaattgagtgtccccacacagttagttttggagagaacagtgttacaggatatgttgaactgcctcctatgccactggctgacacaacgcaaatggtgccggaaagctcttgcagcatggataatcaccaatcattaaacacaatcacaaaatacacccaaataatctggagaggaaaggctgatcaatcccaatccagccaaaattcatttgagacagtgtctactgaggttgaccttaaaggaacctgtgtattaaaacacaagatgatagaagaatcataccgcagtcggaagtcaataacttgttatgatctgtcctgcaacagcacctattgcaaaccaactctgtacatgatcgtaccaatccatgcatgtaatatgatgaagagctgtttaattgcactaggaccttatagggtccaggttgtttatgaaagaacctattgcatgacaggggttttaattgaagggaaatgctttgttcctgaccagagtgtagttagtatcattaaacatgggatcttcgatattgcaagtgtccacattgtttgctttattgttgcagtcaaaggaaacacatacaagatctttgaacaggttaaaaagacatttgaatctaattgtaatgacactgaaaataaagtgcaagggtactacatttgtattatagggggaaattcctcacccgtatatgtaccaacactggatgattttaggtcaatggaagcattctcaggaattattagatcaccacatggagaggaccatgatctagctggagaagaggttgcatcatattctattgttggacctgctaatgctaaggtgccccatagtgccagctcagacacattaggcttaattgcttattctagtataccatcttattcttctctcagcatcctcacaagctcaacagaagcaaagcatgtgttcagccctggattattccgccagctaaaccatacaaagtgtgacaaaactgctataccattgacatggacagggatgattgaccttcctggatactatgaagctatacatccttgcacagttttctgtgtcttgtcaggtcccggggcttcatgtgaggctttttctgaaggtggaatcttcaatatagcttctccaatgtgtctagtgtcaaagcagaatcgttttagactaacagaacaacaggtgaattttgtatgccagagggttgatgttgacattattgtctattgtaatggtcagagaaaagtaatattaacaaagactctggttattgggcaatgtatatatactataacgagcctattctcactattacctggggtagcacattcaattgcagttgaactgtgtgttcctgggttccatgggtgggccacagctgcattacttgttacattttgctttggttgggttctcatcccagcaatcacattcattatattgacaattttaaagttcattgcaaatatcttccacacaagcaatcaggagaataggctaaagtcagtactcagaaagataaaggaagaatttgaaaggacaaagggatcaatggtgtgtgatatatgtaaatatgagtgtgagacttataaagaactaaaggcacatggggtctcatgcccacaatcccaatgcccttattgtttcacccactgtgagcccacagaagctgcatttcaggcccattataaagtgtgtcaagttactcatagatttagggatgatttaaagaagacagttactccccagaacttcacacctggttgctatcgaacattgaatttattcagatataagagtaggtgttatatttttacaatgtgggtttttcttttagtcttagaatcaatcttatgggctgcaagtgcatcagaaatacctttaaatccagtatggaacgacaatgcccatggggtgggttctatcccaatgcatacagacttggaattggacttttccttgacatcaagctcaaagtacacctaccgaaggaaactaacaaacccacttgaagaatctcaggcaattgacctccatgtagaaatagaagagcaaacaattggtgtagatgtgcatgcattgggtcattggtttgatggccgccttaatcttaagacatcctttcactgttacggtgcatgcaccaagtatgagtacccatggcatactgcaaaatgccactatgaaagggattaccaatatgagacaagttggggttgtaacccttcagactgtcctggtgtaggtacaggctgtactgcatgtgggttatatcttgatcagttgaaacctgttggaagtgcttacaaaatcattacaatacgatatagcagaagagtttgtgttcaatttggagaggaaaatctctgtaaaattatagatatgaatgattgctttgtttctaggcatgttaaagtctgtataatcggcacagtttctaaattttctcaaggtgatacactcctattctttggaccacttgaaggtggtggtctaatatttaaacattggtgcacatcaacatgccagtttggggacccaggagatattatgagtccaagagataagggatttttatgccctgagttcccaggtagctttagaaagaagtgtaattttgccacaacccctgtttgtgaatatgatgggaatatggtttcaggttataaaaaagtaatggccacaattgattctattcaatccttcaatacaagcactatgcatttcactgatgagaggatagaatggaaagaccctgatgggatgttaagggaccatattaacattctggttacaaaggatattgactttgataatcttggtgaaaatccctgcaagattggattacaaacatcctccattgaaggggcatgggggtctggtgtaggctttacacttacatgtttgatatcactgacagaatgctctacattcttgacctcaatcaaagcttgtgacaaggcaatctgttatggtgcagagagtgtgacacttacaagaggtcaaaatacagtgaaagtgtcaggaaagggcggacatagcggctcatccttcaaatgctgtcatggggaagaatgctcacagataggactccatgctgctgcacctcatcttgacaaggttaacgggatttcagagatggagaacagtaaagtgtttgatgatggggcaccacagtgtgggataaaatgctggtttgttaaatcaggggaatggatttctgggattttcagcggtaattggattgtacttattgttctatgtgtatttctactattctcattggtattgcttagtattctctgtcctgtcagaaagcataaaaagtcatag

SEQ ID NO: 3359 - RNA, 3408 nt, synthetic construct
  misc_feature 1..3408: note = derived and/or modified CDS sequence (wt) from HTNV(CGHu3614)__EF990922.1__GP
  source 1..3408: mol_type = other RNA
atggggatatggaagtggctagtaatggccagtttagtctggccagcctttgcactaaggaatctgtatgacatgaaaattgagtgtccccacacagttagttttggagagaacagtgttacaggatatgttgaactgcctcctatgccactggctgacacaacgcaaatggtgccggaaagctcttgcagcatggataatcaccaatcattaaacacaatcacaaaatacacccaaataatctggagaggaaaggctgatcaatcccaatccagccaaaattcatttgagacagtgtctactgaggttgaccttaaaggaacctgtgtattaaaacacaagatgatagaagaatcataccgcagtcggaagtcaataacttgttatgatctgtcctgcaacagcacctattgcaaaccaactctgtacatgatcgtaccaatccatgcatgtaatatgatgaagagctgtttaattgcactaggaccttatagggtccaggttgtttatgaaagaacctattgcatgacaggggttttaattgaagggaaatgctttgttcctgaccagagtgtagttagtatcattaaacatgggatcttcgatattgcaagtgtccacattgtttgcttttttgttgcagtcaaaggaaacacatacaagatctttgaacaggttaaaaagacatttgaatctaattgtaatgacactgaaaataaagtgcaagggtactacatttgtattatagggggaaattcctcacccgtatatgtaccaacactggatgattttaggtcaatggaagcattctcaggaatttttagatcaccacatggagaggaccatgatctagctggagaagaggttgcatcatattctattgttggacctgctaatgctaaggtgccccatagtgccagctcagacacattaggcttaattgcttattctagtataccatcttattcttctctcagcatcctcacaagctcaacagaagcaaagcatgtgttcagccctggattattcccccagctaaaccatacaaagtgtgacaaaactgctataccattgacatggacagggatgattgaccttcctggatactatgaagctatacatccttgcacagttttctgtgtcttgtcaggtcccggggcttcatgtgaggctttttctgaaggtggaatcttcaatatagcttctccaatgtgtctagtgtcaaagcagaatcgttttagactaacagaacaacaggtgaattttgtatgccagagggttgatgttgacattattgtctattgtaatggtcagagaaaagtaatattaacaaagactctggttattgggcaatgtatatatactataacgagcctattctcactattacctggggtagcacattcaattgcagttgaactgtgtgttcctgggttccatgggtgggccacagctgcattacttgttacattttgctttggttgggttctcatcccagcaatcacattcattatattgacaattttaaagttcattgcaaatatcttccacacaagcaatcaggagaataggctaaagtcagtactcagaaagataaaggaagaatttgaaaggacaaagggatcaatggtgtgtgatatatgtaaatatgagtgtgagacttataaagaactaaaggcacatggggtctcatgcccacaatcccaatgcccttattgtttcacccactgtgagcccacagaagctgcatttcaggcccattataaagtgtgtcaagttactcatagatttagggatgatttaaagaagacagttactccccagaacttcacacctggttgctatcgaacattgaatttattcagatataagagtaggtgttatatttttacaatgtgggtttttcttttagtcttagaatcaatcttatgggctgcaagtgcatcagaaatacctttaaatccagtatggaacgacaatgcccatggggtgggttctatcccaatgcatacagacttggaattggacttttccttgacatcaagctcaaagtacacctaccgaaggaaactaacaaacccacttgaagaatctcaggcaattgacctccatgtagaaatagaagagcaaacaattggtgtagatgtgcatgcattgggtcattggtttgatggccgccttaatcttaagacatcctttcactgttacggtgcatgcaccaagtatgagtacccatggcatactgcaaaatgccactatgaaagggattaccaatatgagacaagttggggttgtaacccttcagactgtcctggtgtaggtacaggctgtactgcatgtgggttatatcttgatcagttgaaacctgttggaagtgcttacaaaatcattacaatacgatatagcagaagagtttgtgttcaatttggagaggaaaatctctgtaaaattatagatatgaatgattgctttgtttctaggcatgttaaagtctgtataatcggcacagtttctaaattttctcaaggtgatacactcctattctttggaccacttgaaggtggtggtctaatatttaaacattggtgcacatcaacatgccagtttggggacccaggagatattatgagtccaagagataagggatttttatgccctgagttcccaggtagctttagaaagaagtgtaattttgccacaacccctgtttgtgaatatgatgggaatatggtttcaggttataaaaaagtaatggccacaattgattcttttcaatccttcaatacaagcactatgcatttcactgatgagaggatagaatggaaagaccctgatgggatgttaagggaccatattaacattctggttacaaaggatattgactttgataatcttggtgaaaatccctgcaagattggattacaaacatcctccattgaaggggcatgggggtctggtgtaggctttacacttacatgtttgatatcactgacagaatgctctacattcttgacctcaatcaaagcttgtgacaaggcaatctgttatggtgcagagagtgtgacacttacaagaggtcaaaatacagtgaaagtgtcaggaaagggcggacatagcggctcatccttcaaatgctgtcatggggaagaatgctcacagataggactccatgctgctgcacctcatcttgacaaggttaacgggatttcagagatggagaacagtaaagtgtttgatgatggggcaccacagtgtgggataaaatgctggtttgttaaatcaggggaatggatttctgggattttcagcggtaattggattgtacttattgttctatgtgtatttctactattctcattggtattgcttagtattctctgtcctgtcagaaagcataaaaagtcatag

SEQ ID NO: 3360 - RNA, 3408 nt, synthetic construct
  misc_feature 1..3408: note = derived and/or modified CDS sequence (wt) from HTNV(CGRn15)__EU363814.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagatacaatacaaatggtgcctgaaagttcttgtagcatggacaaccaccagtccttgagcacagtaacaaagtatacacaagtgagttggagggggaaagctgaccaggcacagtctagccagacttcatctgagacagtgtctgttgaagttgatcttaaggggacctgtgtattaaaacacaaattggtagaagaatcataccgtagccggaagtcactaacttgttatgacctctcttgtaacagtacctactgcaagccaacactgtacatgattgtaccaatccatgcatgcaacatgatgaagagctgcataattgcactagggccgcatagagtacaagtggtatacgagagaacatattgcatgactggggttctattagaagggaagtgttttgtcccagatcagagtgtagtcagcattgtcaggcacggtatctttgacattgcaagtgttcatattgcatgtttttttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacactaagtctaattgctttttcaggaataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgttttatcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccataacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatttttcacacaagtaatcaagagaataggctaaaaatggtcttgaaaaaaatcaaggaagagtttgaaaggacaaagggatcaatggtatgtgatatctgtaaatatgagtgtgaaacctacaaagagttgaaggcacatggagtttcatgtcctcaatctcaatgcccttattgttttacccactgtgaacctacagaatcagcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtccttgagtcaatcctgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaggcaattggtgttgacgttcatgcattgggacactggtttgatggtcgtttaaatctcaagacatcctttcattgttacggtgcatgcacaaaatatgaatacccatggcatactgcaaagtgccactatgaaagggattatcaatatgagacgagctggggttctaatccatcagattgcccaggggtgggtacaggatgtacagcatgtgggttatatctagaccagttaaaaccagttggcagtgcatacaaaattattacaataaggtatagtaggagagtttgtgttcaatttggtgaagaaaatctttgcaaagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatgatggaaatatggtctcaggatataagaaagtaatggctacaattgattcatttcaatcctccaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgccgcacctcatcttgataaggtcaatgggatctctgaaatagaaaatagtaaagtatatgatgatggagcaccacagtgtggggttaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3361 - RNA, 3408 nt, synthetic construct
  misc_feature 1..3408: note = derived and/or modified CDS sequence (wt) from HTNV(CGRn2616)__EU363816.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagatacaatacaaatggtgcctgaaagttcttgtagcatggacaaccaccagtccttgagcacagtgacaaagcatacacaagtgagttggagagggaaagctgaccaggcacagtctagccagacttcatttgagacagtgtctgttgaagttgatcttaaggggacctgtgtattaaaacacaaattggtagaagaatcataccgtagccggaagtcactaacttgttatgacctctcttgtaacagtacctactgcaagccaacactgtacatgatcgtaccaatccatgcatgcaacatgatgaagagctgcataattgcactagggccgcatagagtacaagtggtatacgagagaacatattgcatgactggggttctattagaagggaagtgttttgtcccagatcagagtgtagtcagcattgtcaggcacggtatctttgacattgcaagtgttcatattgcatgtttttttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacactaagtctaattgctttttcaggaataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgttttgtcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccataacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatttttcacacaagtaatcaagagaataggctaaaaatggtcttgaaaaaaatcaaggaagagtttgaaaggacaaagggatcaatggtatgtgatatctgtaaatatgagtgtgaaaccaacaaagagttgaaggcacatggagtttcatgtcctcaatctcaatgcccttattgttttacccactgtgaacctacagaatcagcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtccttgagtcaatcctgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaggcaattggtgttgacgttcatgcattgggacactggtttgatggtcgtttaaatctcaagacatcctttcattgttacggtgcatgcacaaaatatgaatacccatggcatactgcaaagtgccactatgaaagggattatcaatatgagacaagttggggttgtaacccatcagattgcccaggggtcggcacaggctgtacagcatgtgggttatatctagaccagttaaaaccagttggcagtgcatacaaaattattacaataaggtatagtaggagagtttgtgttcaatttggtgaagaaaatctttgcatagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatggtggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3362 - RNA, 3408 nt, synthetic construct
  misc_feature 1..3408: note = derived and/or modified CDS sequence (wt) from HTNV(CGRn2618)__EU363817.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagatacaatacaaatggtgcctgaaagttcttgtagcatggacaaccaccagtccttgagcacagtaacaaagtatacacaagtgagttggagagggaaagctgaccaggcacagtctagccagactccatttgagacagtgtctgttgaagttgatcttaagaggacctgtgtattaaaacacaaattggtagaagaatcataccgtagccggaagtcactaacttgttatgacctctcttgtaacagtacctactgcaagccaacactgtacatgatcgtaccaatccatgcatgcaacatgatgaagagctgcataattgcactagggccgcatagagtacaagtggtatacgagagaacatattgcatgactggggttctattagaagggaagtgttttgtcccagatcagagtgtagtcagcattgtcaggcacggtatctttgacattgcaagtgttcatattgcatgtttttttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacactaagtctaattgctttttcagggataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgttttatcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccataacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatttttcacacaagtaatcaagagaataggctaaaaatggtcttgaaaaaaatcaaggaagagtttgaaaggacaaagggatcaatggtatgtgatatctgtaaatatgagtgtgaaacctacaaagagttgaaggcacatggagtttcatgtcctcaatctcaatgcccttattgttttacccactgtgaacctacagaatcagcatttcaggcccattatagagtttgtcaagtcactcatcgatttagagatgacctaaagaagactgttactccccagaactttacacctgggtgttaccgtacattaaatttatttagatataaaagcaggtgctacatactcacaatgtggaatctccttctcatccccgggtaccgactgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaggcaattggtgttgacgttcatgcattgggacactggtttgatggtcgtttaaatctcaagacatcctttcattgttacggtgcatgcacaaaatatgagtacccatggcatactgcaaagtgccactatgaaagggattatcaatatgagacaagttggggttgtaacccatcagattgcccaggggtgggtacaggatgtacagcatgtgggttatatctagaccagttaaaaccagttggcagtgcatacaaaattattacaataaggtatagtaggagagtttgtgttcaatttggtgaagaaaatctttgcatagtcatagatatgaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatggtggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3363 - RNA, 3408 nt, synthetic construct
  misc_feature 1..3408: note = derived and/or modified CDS sequence (wt) from HTNV(CGRn45)__EU092225.1__GP
  source 1..3408: mol_type = other RNA
atggagatatggaagtggcttgtgatggccagtttagtatggcctgccttagcactgaggaatgtccatgacatgaaaattgagtgcccccacacagtcagttttggaaaaaacagtgtaattggttatgttgaattgcctcctatgccattggcagatacaatacaaatggtgcctgaaagttcttgtagcatggacaaccaccagtccttgagcacagtaacaaagtatacacaagtgagttggagagggaaagctgaccaggcacagtctagccagacttcatttgaggcagtgtctgttgaagttgatcttaaggggacctgtgtattaaaacacaaattggtagaagaatcataccgtagccggaagtcactaacttgttatgacctctcttgtaacagtacctactgcaagccaacactgtacatgatcgtaccaatccatgcatgcaacatgatgaagagctgcataattgcactagggccgcatagagtacaagtggtatacgagagaacatattgcatgactggggttctattagaagggaagtgttttgtcccagatcagagtgtagtcagcattgtcaggcacggtatctttgacattgcaagtgttcatattgcatgtttttttgtagcgatcacagggaacacatataagctttttgaacaagttaagaagtcatttgggacaacatgcaatgacactgaaaataaggtgcaaggttactacatctgtattcttggaggaaactccccacctatttatgtcccaacacttgatgattttagatccatggaggcattctcgggaatattcaaatcaccacatggagaagatcatgacctagctggggaagaaattgcttcatactctattgttggacctgctaatgcaaaggtcccccatagtgccagctcagatacactaagtctaattgctttttcaggaataccatcttactcttctcttagtattctcaccagttcaacagaagctaagcatgtgtttagccctggactattcccacagcttaatcatacaaaatgtgataagactgctataccattaacatggactggaataattgacttgcctggatattatgaggctgtacatccttgcacagtgttctgtgttttatcaggtccaggtgcatcatgtgaggcattttcagaaggtgggatctttaacataacctctcctatgtgtctggtatcaaagcaaaacaggtttcgactaacagaacagcaagtcaactttgtatgccagagagttgatatggacatcgtggtttattgtaatggtcagaggaaggtgatattaacaaaaaccttagttattggacaatgtatatacaccataacaagtctattctcactgctacctggggtagcacactctattgctgttgagttgtgtgtacctggatttcatgggtgggctacggctgctttacttatcaccttttgttttgggtgggttcttataccagcacttacatttattgtacttactgtattgaagttcattgcaaatatttttcacacaagtaatcaagagaataggctaaaaatggtcttgaaaaaaatcaaggaagagtttgaaaggacaaagggatcaatggtatgtgatatctgtaaatatgagtgtgaaacctacaaagagttgaaggcacatggagtttcatgtcctcaatctcaatgcccttattgttttacccactgtgaacctacagaatcagcatttcaggcccattatagagtttgtcaagtcactcatcgatttagagatgacctaaagaagactgttactccccagaactttacacctgggtgttaccgtacattaaatttatttagatataaaagtaggtgttacattttcacaatgtggatctgtcttttagtccttgagtcaatcctgtgggctgctagtgcatcagaaatacccttaagccctacgtggaatgataatgctcatggggttggatccatacccatgcatacagatctagagcttgacttttctttaacatcaagttctaagtatacataccggagaaagctaacaaatccacttgaagaatcacaagcagtcaatttccatgtggaaatagaagagcaggcaattggtgttgacgttcatgcattgggacactggtttgatggtcgtttaaatctcaagacatcctttcattgttacggtgcatgcacaaaatatgaatacccatggcatactgcaaagtgccactatgaaagggatcatcaatatgagacaagttggggttgtaacccatcagattgcccaggggtgggtacaggatgtacagcatgtgggttatatctagaccagttaaaaccagttggcagtgcatacaaaattattacaataaggtatagtaggagagtttgtgttcaatttggtgaagaaaatctttgcaaagtcatagataggaatgattgttttgtgtctagacatgtcaaggtctgtataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatgatggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagccatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgtttctactattttcattggtgttgcttagcatcctttgtcctgttagaaaacacaaaaaatcataa

SEQ ID NO: 3364 - RNA, 3408 nt, synthetic construct
  misc_feature 1..3408: note = derived and/or modified CDS sequence (wt) from HTNV(CGRn53)__EF990921.1__GP
  source 1..3408: mol_type = other RNA
atggggatatggaagtggctagtgatggccagtttagtatggccagcttacacactgagaaatgtgtatgacatgaaaattgaatgcccccatactgtaagttttggtgagaacagtgtgatagggtatgtggagttacctcctataccattagctgacacaacacaaatggtaccggaaagttcttgcagtatggacaaccaccagtcattgaatacaataacaaaatatacccaagtaagttggagaggtaaggctggtcaggcacaggccagccagaactcatttgaagcagtgtctgctgaagttgacctcaaaggaacttgtgttttaaagcataaaatgttagaagagtcataccgcagcagaaaatcaatagcttgttatgacctctcttgtaatagtacctattgcaagcctaccctgtatatgattgtgccaatccatgcatgcaatatgatgaaaagttgtttaattgcattaggaccccacagggtccaagtggtctatgaaagaacctactgcatgacaggggttctgatagaaggaaaatgttttgtcccagaccaaagtgttgtaagcattattaagcatggtatctttgacattgcaagtgtccacattgtttgcttctttgtggcagtcaaaggaaacacttacaagatttttgagcagataaaaaagtcatttgagtccacatgcaatgatactaagaataaggtacagggatattacatctgcattgtagggggaaactctgcacctatatatgtgccaacacttgatgactttagatcaatggaagcattctcagggatctttagatcaccacatggggaggaccatgatttggctggagaagaaattgcttcatactctattgttggacctgccaatgcaaaagtacctcatagtgccagttcagacacattgagtctgactgcctattcaggtataccatcttattcctcacttagtatccttgcaggttcagcagaagctaagcatgtatttagtcctggattcttcccacagcttaatcatacaaaatgtgataagactgctataccattgatgtggacaggaatgattgacttgcctgggtattatgaggccatacatccttgtacagtcttctgtgttttatcaggcccaggggcatcatgtgaagcattttcagaaggtggcattttcaacataacatccccaatgtgtttagtctcaaaacagaaccgattccggctgacagaacagcaagtaaactttgtttgtcagagagttgatatggacattattgtgtattgtaatggtcagaggaaagtgatactaacaaaaaccttagttataggacagtgtatatataccataacaagtttgttctcactgttacctggggtagcacattctattgctgttgagttatgcgtccctgggtttcatgggtgggctacagctgctttgcttgttacattttgctttggctgggttctaataccagcaatgacatttattgtgctaacaattttgaaattcattgcaaatattttccatacaagtaaccaagagaataagcttaaatcagtactgaggaagataaaagaggaatttgaaaaaacaaaaggatcaatggtgtgtgatgtgtgtaaatatgagtgtgagacctacaaggagttgaaggcacatggggtttcatgtccccaatctcagtgcccatattgcttcactcattgtgaacctacagaagcagcattccaggctcattatagggtatgtcaagtcacccataggttcagagatgatttaaagaagactgtcactcctcaaaattttacacctggttgttatcggacgttaaaccttttcagatataaaagcaggtgctacatcctcacaatgtggaatctcctcctggtccccgggtaccgagcttgggctgcaagtgcatcggaaatacccttaaaccctgtatggaatgacaacgcccatggagtaggttctgtaccgatgcacacagacttagagctggatttttctttaacatcaagttccaagtatacataccgtaggaaactaacaaatccgctagaagaatcacaggcaattaaccttcatattgaaatagaagaacagacaattggagttgatgtgcatgctttaggccattggtttgttggtcgtctcaatcttaagacatcctttcactgctatggtgcttgtacaaaatatgaatatccatggcatacagcaaagtgtcactatgagcgggattatcagtatgaaacaagttggggctgtaatccatctgactgccctggggtaggtacgggctgtacagcatgcggattgtaccttgaccaattaaagcctgttggtagtgcatacaaaattattacaataagatacagcagaagagtatgtgtccaatttggggaagaaaatctatgtaagatcatagacatgaatgactgttttgtatccagacatgtcaaggtatgcataattggtacagtctctaaattttcccagggtgacacgctattattctttggacctctcgagggtggcggcttaatattcaaacactggtgtacatctacctgccaatttggggaccctggagatatcatgagtccaagggacaaaggatttttatgccctgaattcccaggtagtttcaggaagaaatgcaacttcgctactacccctctctgtgaatatgatggaaatatggtatcagggtacaaaaaagtaatggcaacaattgattcctttcaatcctttaacactagtactatgcacttcactgatgagagaatagaatggaaagaccctgatggaatgttacgagaccacattaatattctagtaactaaggatattgactttgagaatcttggtgaaaatccctgtaaaattggcttacagacatcctcaattgagggggcatggggctctggtgttggcttcaccctcacatgtttagtatcattgacagagtgccctacctttttaacatcaattaaggcttgcgataaagccatctgctatggtgcagaaagtgtaacattaacaagaggccagaatacagtcaaagtgtcagggaagggtggccatagtggctcaacttttaaatgctgtcatggggaagaatgttcacagattggactccatgctgctgcacctcaccttgataaggttaatgggatttctgaaattgagaataataaagtttatgatgatggtgcaccccagtgtgggataaagtgctggtttgtaaaatctggagaatggatttcagggattttcagtgggaactggattgtgctcattgtcctctgtgtgtttttattgttttcattgatattactcagtattctttgccctgtaagaaagcacaaaaagtcatag

SEQ ID NO: 3365 - RNA, 3408 nt, synthetic construct
  misc_feature 1..3408: note = derived and/or modified CDS sequence (wt) from HTNV(CGRn93MP8)__EF990919.1__GP
  source 1..3408: mol_type = other RNA
atggggatatggaagtggctagtgaaggccagtttagtatggccagcttacacactgagaaatgtgtatgacatgaaaattgaatgcccccatactgtaagttttggtgagaacagtgtgatagggtatgtggagttacctcctataccattagctgacacaacacatatggtaccggaaagttcttgcagtatggacaaccaccagtcattgaatacaataacaaaatatacccaagtaagttggagaggtaaggctgatcaggcacaggccagccagaactcatttgaagcagtgtctgctgaagttgacctcaaaggaacttgtgttttaaagcataaaatgttagaagagtcataccgcagcagaaaatcaatagcttgttatgacctctcttgtaatagtacctattgcaagcctaccctgtatatgattgtgccaatccatgcatgcaatatgatgaaaagttgtttaattgcattaggaccccacagggtccaagtggtctatgaaagaacctactgcatgacagggtttctgatagaaggaaaatgttttgtcccagaccgaagtgttgtaagcattattaagcatggtatctttgacattgcaagtgtccacattgtttgcttctttgtggcagttaaaggaaacacttacaagatttttgagcagataaaaaagtcatttgagtccacatgcaatgatactaagaataaggtacagggatattacatctgcattgtagggggaaactctgcacctatatatgtgccaacacttgatgactttagatcaatggaagcattctcagggatctttagatcaccacatggggaggaccatgatttggctggagaagaaattgcttcatactctattgttggacctgccaatgcaaaagtacctcatagtgccagttcagacacattgagtctgactgcctattcaggtataccatcttattcctcacttagtatccttgcaggttcagcagaagctaagcatgtatttagtcctggattcttaccacagcttaatcatacaaaatgtgataagactgctataccattgatgtggacaggaatgattgacttgcctgggtattatgaggccatacatccttgtacagtcttctgtgttttatcaggcccaggggcatcatgtgaagcattttcagaaggtggcattttcaacataacatccccaatgtgtttagtctcaaaacagaaccgattccggctgacagaacagcaagtaaactttgtttgtcagagagttgatatggacattattgtgtattgtaatggtcagaggaaagtgatactaacaaaaaccttagttataggacagtgtatatataccataacaagtttgttctcactgttacctggggtcgcacattctattgctgttgagttatgcgtccctgggtttcatgggtgggctacagctgctttgcttgttacattttgctttggctgggttctaataccagcaatgacatttattgtgctaacaattttgaaattcattgcaaatattttccatacaagtaaccaagagaataagcttaaatcagtactgaggaagataaaagaggaatttgaaaaaacaaaaggatcaatggtgtgtgatgtgtgtaaatatgagtgtgagacctacaaggagttgaaggcacatggggtttcatgtccccaatctcaatgcccatattgcttcactcattgtgaacctacagaagcagcattccaggctcattatagggtatgtcaagtcacccataggttcagagatgatttaaagaagactgtcactcctcaaaattttacacctggttgttatcggacgttaaaccttttcagatataaaagtagatgttacatttttacaatgtgggtcttcctcctggttttggagtccatactgtgggctgcaagtgcatcggaaatacccttaaaccctgtatggaatgacaacgcccatggagtaggttctgtaccgatgcacacagacttagagctggatttttctttaacatcaagttccaagtatacataccgtaggaaactaacaaatccgctagaagaatcacaggcaattaaccttcatatagaaatagaagaacagacaattggagttgatgtgcatgctttaggccattggtttgatggtcgtctcaatcttaagacatcctttcactgctatggtgcttgtacaaaatatgaatatccatggcatacagcaaagtgtcactatgagcgagattatcagtatgaaacaagttggggctgtaatccatctgactgccctggggtaggtacgggctgtacagcatgcggattgtaccttgaccaattaaagcctgttggtagtgcatacaaaattattacaataagatacagcagaagggtatgtgtccaatttggggaagaaaatctatgtaagatcatagacatgaatgactgttttgtatccagacatgtcaaggtatgcataattggtacagtctctaaattttcccagggtgacacgctattattctttggacctctcgagggtggcggcttaatattcaaacactggtgtacatctacctgccaatttggggaccctggagatatcatgagtccaagggacaaaggatttttatgccctgaattcccaggtagtttcaggaagaaatgcaacttcgctactacccctctctgtgaatatgatggaaatatggtatcagggtacaaaaaagtaatggcaacaattgattcctttcaatcctttaacactagtactatgcacttcactgatgagagaatagaatggaaagaccctgatggaatgttacgagaccacattaatattctagtaactaaggatattgactttgagaatcttggtgaaaatccctgtaaaattggcttacagacatcctcaattgagggggcatggggctctggtgttggcttcaccctcacatgtttagtatcattgacagagtgccctacctttttaacatcaattaaggcttgcgataaagccatctgctatggtgcagaaagtgtaacattaacaagaggccagaatacagtcaaagtgtcagggaagggaggccatagtggctcaacttttaaatgctgtcatggggaagaatgttcacagattggactccatgctgctgcacctcaccttgataaggttaatgggatttctgaaattgagaataataaagtttatgatgatggtgcaccccagtgtgggataaagtgctggtttgtaaaatctggagaatggatttcagggattttcagtgggaactggattgtgctcattgtcctctgtgtgtttttattgttttcattgatattactcagtattctttgccctgtaagaaagcacgaaaagtcatag

SEQ ID NO: 3366 - RNA, 3408 nt, synthetic construct
  misc_feature 1..3408: note = derived and/or modified CDS sequence (wt) from HTNV(CGRn93P8)__EF990918.1__GP
  source 1..3408: mol_type = other RNA
atggggatatggaagtggctagtgatggccagtttagtatggccagcttacacactgagaaatgtgtatgacatgaaaattgaatgcccccatactgtaagttttggtgagaacagtgtgatagggtatgtggagttacctcctataccattagctgacacaacacaaatggtaccggaaagttcttgcagtatggacaaccaccagtcattgaatacaataacaaaatatacccaagtaagttggagaggtaaggctgatcaggcacaggccagccagaactcatttgaagcagtgtctgctgaagttgacctcaaaggaacttgtgttttaaagcataaaatgttagaagagtcataccgcagcagaaaatcaatagcttgttatgacctctcttgtaatagtacctattgcaagcctaccctgtatatgattgtgccaatccatgcatgcaatatgatgaaaagttgtttaattgcattaggaccccacagggtccaagtggtctatgaaagaacctactgcatgacaggggttctgatagaaggaaaatgctttgtcccagaccgaagtgttgtaagcattattaagcatggtatctttgacattgcaagtgtccacattgtttgcttctttgtggcagttaaaggaaacaattacaagatttttgagcagataaaaaagtcatttgagtccacatgcaatgatactaagaataaggtacagggatattacatctgcattgtagggggaaactctgcacctatatatgtgccaacacttgatgactttagatcaatggaagcattctcagggatctttagatcaccacatggggaggaccatgatttggctggagaagaaattgcttcatactctattgttggacctgccaatgcaaaagtacctcatagtgccagttcagacacattgagtctgactgcctattcaggtataccatcttattcctcacttagtatccttgcaggttcagcagaagctaagcatgtatttagtcctggattcttcccacagcttaatcatacaaaatgtgataagactgctataccattgatgtggacaggaatgattgacttgcctgggtattatgaggccatacatccttgtacagtcttctgtgttttatcaggcccaggggcatcatgtgaagcattttcagaaggtggcattttcaacataacatccccaatgtgtttagtctcaaaacagaaccgattccggctgacagaacagcaagtaaactttgtttgtcagagagttgatatggacattattgtgtattgtaatggtcagaggaaagtgatactaacaaaaaccttagttataggacagtgtatatataccataacaagtttgttctcactgttacctggggtagcacattctattgctgttgagttatgcgtccctgggtttcatgggtgggctacagctgctttgcttgttacattttgctttggctgggttctaataccagcaatgacatttattgtgctaacaattttgaaattcattgcaaatattttccatacaagtaaccaagagaataagcttaaatcagtactgaggaagataaaagaggaatttgaaaaaacaaaaggatcaatggtgtgtgatgtgtgtaaatatgagtgtgagacctacaaggagttgaaggcacatggggtttcatgtccccaatctcaatgcccatattgcttcactcattgtgaacctacagaagcagcattccaggctcattatagggtatgtcaagtcacccataggttcagagatgatttaaagaagactgtcactcctcaaaattttacacctgtttgttatcggacgttaaaccttttcagatataaaagtagatgttacatttttacaatgtgggtcttcctcctggttttggagtccatactttgggctgctagtgcatcggaaatacccttaaaccctgtatggaatgacaacgcccatggagtaggttctgtgccgatgcacacagacttagagctggatttttctttaacatcaagttccaagtatacataccgtaggaaactaacaaatccgctagaagaatcacaggcaattaaccttcatattgaaatagaagaacagacaattggagttgatgtgcatgctttaggccactggtttgatggtcgtctcaatcttaagacatcctttcactgctatggtgcttgtacaaaatatgaatatccatggcatacagcaaagtgtcactatgagcgggattatcagtatgaaacaagttggggttgtaatccatctgactgccctggggtcggcacaggctgtacaatatgcggattgtaccttgaccaattaaagcctgttggtagtgcatacaaaattattacaataaggtatagtaggagagtttgtgttcaatttggtgaagaaaatctttgcaaagtcatagatatgaatgattgttttgtgtctagacatgtcaaggtctgcataattggtacagtttctaaattctcccaaggtgacacattattgttctttgggccgcttgaaggtggtggtttaattttcaaacattggtgcacatctacatgccagtttggagacccgggagatatcatgagcccaagagataaaggttttttatgtcctgaatttccaggcagttttaggaaaaaatgcaactttgccactacccctgtttgtgaatatgatggaaatatggtctcaggatataagaaagtaatggctacaattgattcatttcaatccttcaatactagtaccatgcattttactgatgagaggatagaatggaaagatcctgacgggatgttaagggatcacatcaatattttagtgacaaaagacattgattttgacaatcttggtgaaaatccttgtaagattggcttacagacatcctccattgaaggggcatggggctcaggtgtaggcttcacgcttacatgcttgatatcactaacagagtgccctaccttcttaacatcaatcaaggcctgtgacaaagctatatgttatggtgcagaaagcgtaacattaacaagagggcaaaacacagtcaaagtatcagggaaaggcgggcatagtggctcaacatttaaatgctgtcatggagaagactgttcacagagcgggcttcatgctgctgcacctcatcttgataaggtcaatgggatctctgaaatagaaaatagtaaagtatatgatgatggagcaccacagtgtgggattaaatgttggtttgtcaaatctggagagtggatctcagggattttcagtggtaactggattgtcctcattgtcctctgtgtgtttctactattttcattggtgttgcttagcatcctttgtcctgttagaaaacacaaaaagtcatag

SEQ ID NO: 3367 - RNA, 3408 nt, synthetic construct
  misc_feature 1..3408: note = derived and/or modified CDS sequence (wt) from HTNV(CGRni1)__EU363815.1__GP
  source 1..3408: mol_type = other RNA
atggggatatggaagtggctagtaatggccagtttagtctggccagcctttgcactaaggaatctgtatgacatgaaaattgagtgtccccacacagttagttttggagagaacagtgttacaggatatgttgaactgcctcctatgccactggctgacacaacgcaaatggtgccggaaagctcttgcagcatggataatcaccaatcattaaacacaatcacaaaatacacccaaataatctggagaggaaaggctgatcaatcccaatccagccaaaattcatttgagacagtgtctactgaggttgaccttaaaggaacctgtgtattaaaacacaagatgatagaagaatcataccgcagtcggaagtcaataacttgttatgatctgtcctgcaacagcacctattgcaaaccaactctgtacatgatcgtaccaatccatgcatgtaatatgatgaagagctgtttaattgcactaggaccttatagggtccaggttgtttatgaaagaacctattgcatgacaggggttttaattgaagggaaatgctttgttcctgaccagagtgtagttagtatcattaaacatgggatcttcgatattgcaagtgtccacattgtttgcttttatgttgcagtcaaaggaaacacatacaagatctttgaacaggttaaaaagacatttgaatctaattgtaatgacactgaaaataaagtgcaagggtactacatttgtattatagggggaaattcctcacccgtatatgtaccaacactggatgattttaggtcaatggaagcattctcaggaattattagatcaccacatggagaggaccatgatctagctggagaagaggttgcatcatattctattgttggacctgctaatgctaaggtgccccatagtgccagctcagacacattaggcttaattgcttattctagtataccatcttattcttctctcagcatcctcacaagctcaacagaagcaaagcatgtgttcagccctggattattcccccagctaaaccatacaaagtgtgacaaaactgctataccattgacatggacagggatgattgaccttcctggatactatgaagctatacatccttgcacagttttctgtgtcttgtcaggtcccggggcttcatgtgaggctttttctgaaggtggaatcttcaatatagcttctccaatgtgtctagtgtcaaagcagaatcgttttagactaacagaacaacaggtgaattttgtatgccagagggttgatgttgacattattgtctattgtaatggtcagagaaaagtaatattaacaaagactctggttattgggcaatgtatatatactataacgagcctattctcactattacctggggtagcacattcaattgcagttgaactgtgtgttcctgggttccatgggtgggccacagctgcattacttgttacattttgctttggttgggttctcatcccagcaatcacattcattatattgacaattttaaagttcattgcaaatatcttccacacaagcaatcaggagaataggctaaagtcagtactcagaaagataaaggaagaatttgaaaggacaatgggatcaatggtgtgtgatatatgtaaatatgagtgtgagacttataaagaactaaaggcacatggggtctcatgcccacaatcccaatgcccttattgtttcacccactgtgagcccacagaagctgcatttcaggcccattataaagtgtgtcaagttactcatagatttagggatgatttaaagaagacagttactcgccagaacttcacacctggttgctatcgaacattgaatttattcagatataagagtaggtgttatatttttacaatgtgggtttttcttatagtcttagaatcaatcttatgggctgcaagtgcatcagaaatacctttaaatccagtatggaacgacaatgcccatggggtgggttctatcccaatgcatacagacttggaattggacttttccttgacatcaagctcaaagtacacctaccgaaggaaactaacaaacccacttgaagaatctcaggcaattgacctccatgtagaaatagaagagcaaacaattggtgtagatgtgcatgcattgggtcattggtttgatggccgccttaatcttaagacatcctttcactgttacggtgcatgcaccaagtatgagtacccatggcatactgcaaaatgccactatgaaagggattaccaatatgagacaagttggggttgtaacccttcagactgtcctggtgtaggtacaggctgtactgcatgtgggttatatcttgatcagttgaaacctgttggaagtgcttacaaaatcattacaatacgatatagcagaagagtttgtgttcaatttggagaggaaaatctctgtaaaattatagatatgaatgattgctttgtttctaggcatgttaaagtctgtataatcggcacagtttctaaattttctcaaggtgatacactcctattctttggaccacttgaaggtggtggtctaatatttaaacattggtgcacatcaacatgccagtttggggacccaggagatattatgagtccaagagataagggatttttatgccctgagttcccaggtagctttagaaagaagtgtaattttgccacaacccctgtttgtgaatatgatgggaatatggtttcaggttataaaaaagtaatggccacaattgattcttttcaatccttcaatacaagcactatgcatttcactgatgagaggatagaatggaaagaccctgatgggatgttaagggaccatattaacattctggttacaaaggatattgactttgataatcttggtgaaaatccctgcaagattggattacaaacatcctccattgaaggggcatgggggtctggtgtaggctttacacttacatgtttgatatcactgacagaatgctctacattcttgacctcaatcaaagcttgtgacaaggcaatctgttatggtgcagagagtgtgacacttacaagaggtcaaaatacagtgaaagtgtcaggaaagggcggacatagcggctcatccttcaaatgctgtcatggggaagaatgctcacagataggactccatgctgctgcacctcatcttgacaaggttaacgggatttcagagatggagaacagtaaagtgtttgatgatggggcaccacagtgtgggataaaatgctggtttgttaaatcaggggaatggatttctgggattttcagcggtaattggattgtacttattgttctatgtgtatttctactattctcattggtattgcttagtattctctgtcctgtcagaaagcataaaaagtcatag

SEQ ID NO: 3368 - RNA, 3408 nt, synthetic construct
  misc_feature 1..3408: note = derived and/or modified CDS sequence (wt) from HTNV(Aa10-434)__KU207160.1__GP
  source 1..3408: mol_type = other RNA
atggggatatggaagtggctagtgatggccagtttagtatggcctgttttaacactgagaaatgtctatgacatgaaaattgagtgcccccacacagtaagcttcgggggaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaatttcatttgagacagtgtctactgaagttgacttgaaaggaacatgtgttctgaaacacaagatggtagaagaatcttaccgcagtagaaaatcaataacctgttatgacctatcatgcaatagtacttattgcaagccaacactatacatgattgtgccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggtcagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatttatgttccaacacttgatgatttcagatccatggaagcattcacaggaatcttcagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagtatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtgttatcaggtcctggggcatcatgtgaggccttttctgaaggcgggattttcaacataacctcccccatgtgcttagtgtcaaaacaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagaaaacaggttaaaatcagtacttagaaagataaaggaagagtttgaaaaaacaaaaggctcgatggtatgtgatatctgcaagtatgagtgtgaaacctataaagagttgaaggcacatggtgtgtcatgcccccagtctcaatgcccttattgctttactcattgtgaacccacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaaatatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaagaaaacctttgtaagataatagacatgaatgactgttttgtatctaggcatgttaaggtctgtataattggtacaatatctaaattctctcagggtgatacattattgtttttcggaccacttgaaggtggcggtctaatatttaaacactggtgcacatccacatgtcaatttggcgacccaggagacattatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagtactatgcactttactgatgaaaggatagagtggaaagaccctgatgggatgctgagggatcatataaacatcttagtaacaaaagacatcgactttgataaccttggtgaaaatccttgcaaaattggcctacaggcatcttccattgagggggcctggggttctggcgtagggtttacattaacatgtctggtatcgctaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggactgttcacaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttttattgttctcattggttttactgagcattctctgccccgtgaggaagcataaaaagtcatag

SEQ ID NO: 3369 - RNA, 3408 nt, synthetic construct
  misc_feature 1..3408: note = derived and/or modified CDS sequence (wt) from HTNV(Aa10-518)__KU207161.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtccactgaagttgacttgaaaggaacatgtgttctgaaacacaagatggtagaagaatcttaccgcagtagaaaatcaataacctgttatgacctatcatgcaatagtacttattgcaagccaacactatacatgattgtgccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggtcagtattatcaagcatgggatctttgatatcgcaagtgttcatattgtgtgcttctttgtcgcagttaaagggaatacttataaaatttttgaacaggttaagaaatcctttgaatcaacatgcaatgatacaaagaataaagtgcaggggtattatatctgtattgtagggggaaactctgcaccaatttatgttccaacacttgatgatttcagatccatggaagcattcacaggaatcttcagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagtatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtgttatcaggtcctggggcatcatgtgaggccttttctgaaggcgggattttcaacataacctcccccatgtgcttagtgtcaaaacaaaatcgattccggttaacagaacagcaagtgaattttgtatgtcagcgagtggacgtggacattgttgtgtactgcaatgggcagagaaaagtaatattgacaaaaactttagttattggacaatgtatatacactataacaagcttattttcattactgcctggggtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagaaaacaggttaaaatcagtacttagaaagataaaggaagagtttgaaaaaacaaaaggctcgatggtatgtgatatctgcaagtatgagtgtgaaacctataaagagttgaaggcacatggtgtgtcatgcccccagtctcaatgcccttattgctttactcattgtgaacccacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaaatatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtacagcaggagagtctgtgttcaattcggggaggaaaacctttgtaagatagtagacatgaatgactgttttgtatctaggcatgttaaggtctgtataattggtacagtatctaaattctctcagggtgatacattattgtttttcggaccacttgaaggtggcggtctaatatttaaacactggtgcacatccacatgtcaatttggcgacccaggagacattatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagtactatgcactttactgatgaaaggatagagtggaaagaccctgatgggatgctgagggatcatataaacatcttagtaacaaaagacatcgactttgataaccttggtgaaaatccttgcaaaattggcctacagacatcttccattgagggggcctggggttctggcgtagggtttacattaacatgtctggtatcgctaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggactgttcacaaattggactccatgctgctgcacctcacctagacaaggtcaatgggatttctgagatggaaaacagcaaagtatatgatgatggagcaccgcaatgtgggataaaatgttggtttgttaaatcaggggaatggatttcagggatattcagtggtaattggattgtactcattgttctctgcgtatttttattgttctcattggttttactgagcattctctgccccgtgaggaagcataaaaagtcatag

SEQ ID NO: 3370 - RNA, 3408 nt, synthetic construct
  misc_feature 1..3408: note = derived and/or modified CDS sequence (wt) from HTNV(Aa13_3)__KX687227.1__GP
  source 1..3408: mol_type = other RNA
atggggatatggaagtggctagtgatggccagtttagtatggcctgttttaacactgagaaatgtttatgacatgaaaattgagtgcccccatacagtaagcttcggggaaaatagtgtaataggctatgtggaactaccccccatgccattggttgacacagtacagctggtgcctgagagttcttgcagcatggataatcaccaatcattaaatacaataacaaaatatacccaagtaagttggagaggaaaggctgaccagtcacagtctagccaaaattcatttgagacagtgtctactgaagttgacttgaaaggaacatgtgttctgaaacacaagatggtagaagaatcttaccgcagtagaaaatcaataacctgttatgacctgtcatgcaatagcacttattgcaagccaacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaattctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcgtattcttcccttagcatcctgacaagttcaacagaagccaaacatgtattcagccctgggttgttcccaaaacttaatcacacaaattgtgataaaggtgccataccactcatgtggactgggatgattgatttacctggatactatgaggctatccacccctgtacagtattttgtgtattatcaggtcctggggcatcatgtgaggccttttctgaaggcgggattttcaatataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggagtagcacactctattgctgttgaattgtgtgtacctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcaatggtatgtgatatctgcaaatatgagtgtgaaacctataaagagttaaaggcacatggtgtgtcatgcccccagtctcaatgcccttattgctttactcattgtgaacccacagaagcagcattccaggcccattacaaagtatgccaagttactcacaggttcagggatgatctgaagaaaactgtcactcctcagaatttcacaccaggatgttaccgtacactgaatttatttagatacaaaagtaggtgttacatctttacaatgtggatatttcttcttgtcctagaatctatactatgggctgcaagtgcatcagagacaccactgactcctgtctggaatgacaatgcccatggagtaggttctgttcctatgcacacagatttagaacttgatttctctttaacatctagttccaagtatacataccgcaggaagctaacaaacccacttgaagaagcacaatccattgatctacatattgaaatagaagaacaaacaattggtgtggatgtacatgccctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagtcggtagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgacacattattgtttttcggaccacttgaaggtggtggtctaatatttaaacactggtgcacatccacatgtcaatttggcgatccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacgattgattcctttcaatcttttaatacaagcactatgcactttactgatgaaaggatagagtggaaagaccctgatggaatgctgagggatcacataaacatcttagtaacaaaagacattgactttgataacctcggtgaaaatccctgcaaaattggcctacaaacatcttccattgagggggcctggggttctggtgtagggtttacattaacatgtctggtatcactaacagaatgtcctacctttttgacctcaataaaggcttgtgataaggctatttgttacggtgcagagagtgtaacattaacaagaggacaaaatacagtcaaggtatcaggaaaaggtggccatagtggttcaacatttaagtgttgccatggggaggactgttcacaaattggactccatgctgctgcacctcacctagacaaggtcaatgggatttctgagatggaaaatagcaaagtatatgatgatggagcaccgcaatgtgggataaaatgttggtttgtgaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3371 - RNA, 3408 nt, synthetic construct
  misc_feature 1..3408: note = derived and/or modified CDS sequence (wt) from HTNV(Aa14_186)__KX687228.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacataagatgatagaagaatcttaccgcagtagaaaatcaataacctgttatgacctatcatgcaataacacttattgcaagccaacattatacatgattgtaccaattcatgcatgcaatatgatgaaaagctgtttgattgcattaggaccatacagagtacaggtagtttatgagagaacctattgcatgacaggagtcctgattgaaggaaagtgttttgtcccagatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtattatcaggtcctggggcatcatgcgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtgcctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcgatggtatgtgatatctgcaagtatgagtgtgaaacctataaagagttgaaggcacatggtgtgtcatgcccccagtctcaatgcccttattgctttactcattgtgaacctacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagacttagaacttgatttctctttaacgtctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatcaacatgtcaatttggcgacccaggagacattatgagcccaagagacaaaggttttttatgccccgagttcccaggtagtttcaggaagaaatgcaactttgctaccactcctatttgtgagtatgacggaaatatggtctcaggttacaagaaagtaatggcaacaattgattcctttcaatcttttaatacaagcactatgcactttactgatgaaaggatagagtggaaagaccctgatgggatgctgagggatcatataaacatcttagtaacaaaagacatcgactttgataaccttggtgaaaatccttgcaaaattggcctgcaaacatcttccattgagggggcttggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggattgttcgcaaattggactccatgctgctgcacctcacctagacaaggtcaatgggatttctgaggtggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtgaggaagcataaaaagtcatag

SEQ ID NO: 3372 - RNA, 3408 nt, synthetic construct
  misc_feature 1..3408: note = derived and/or modified CDS sequence (wt) from HTNV(Aa14_234)__KX687230.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaacttcatttgagacagtgtctactgaagttgacttgaaaggaacatgtgttctgaaacacaagatggtagaagaatcttaccgcagtagaaaatcaataacctgttatgacctatcatgcaatagcacatattgcaagcctacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggttagtattatcaagcatgggatctttgatatcgcaagtgttcatattgtgtgcttctttgttgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatttttagatcaccacatggagaagaccatgatctagctggagaagaaactgcaacttactccatagttggacctgccaatgcaaaagtccctcacagtgctagctcagatacattaagcctgattgccttctcaggtataccatcttattcttcccttagcatcctaacaagttcaacagaagccaaacatgtattcagccctggattgttcccaaaacttaatcacacaagttgtgataaaggtgccataccactcatgtggactgggatgattgatttacctggatactatgaggctatccacccctgtacagtattttgtgtattatcaggtcctggggcatcatgtgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtacctggattccatggttgggccacagctgctctgcttgttacattctgttttggatgggttcttataccagcaatcacatttatcatactgacagtcctaaagttcattgctaatattttccacacaagtaaccaagagaacaggctaaaatcagtacttagaaagataaaggaagagtttgaaaaaacaaaaggctcaatggtatgtgatatctgcaagtatgagtgtgaaacctataaagagttaaaggcacacggggtgtcatgcccccagtctcaatgcccttattgctttactcattgtgaacccacagaagcagcattccaagcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatccatactatgggctgcaagtgcatcagagacaccattgactcctgtctggaatgacaatgcccatggagtaggttctgttcctatgcatacagatttagaacttgatttctctttaacatctagttccaagtatacataccgtaggaagctaacaaacccacttgaagaagcacaatccattgatctacatattgaaatagatgaacaaacaattggtgtggatgttcatgctctaggacactggtttgatggtcgtcttaaccttaaaacatcctttcactgttatggtgcttgtacgaagtatgaatacccttggcatactgcaaagtgccactatgaaagggattaccaatatgagacaagctggggttgtaatccatcagattgtcctggggtgggcacaggctgtacagcatgtggtttatatctagaccgattaaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaagcactggtgcacatccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaagaatagagtggaaagaccctgatggaatgctgagggatcatataaacatcttagtaacaaaagacatcgactttgataaccttggtgaaaatccttgcaaaattggcctacaaacatcttccattgagggggcctggggttctggtgtagggtttacattaacatgtctggtatcgctaacagaatgtcctacctttttaacctcaataaaggcttgtgataaggctatctgttatggtgcagagagtgtaacattaacaagagggcaaaatacagtcaaggtatcaggaaaaggtggccatagtggttcaacatttaagtgttgccatggggaggactgttcacaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3373 - RNA, 3408 nt, synthetic construct
  misc_feature 1..3408: note = derived and/or modified CDS sequence (wt) from HTNV(Aa14_239)__KX687231.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacacaagatggtagaagaatcttaccgcagtagaaaatcaataacctgttatgacctatcatgcaatagcacttattgcaagccaacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggttagtattatcaagcatgggatctttgatatcgcaagtgttcatattgtatgcttctttgttgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatttttagatcaccacatggagaagaccatgatctagctggagaagaaactgcaacttactccatagttggacctgccaatgcaaaagttcctcacagtgctagctcagatacattaagcctgattgccttctcaggtataccatcttattcttcccttagcatcctgacaagttcaacagaagccaaacatgtattcagccctggattgttcccaaaacttaatcacacaaattgtgataaaggtgccataccactcatgtggactgggatgattgatttacctggatactatgaggctatccacccctgtacagtattttgtgtattatcaggtcctggggcatcatgtgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtacctggattccatggttgggccacagctgctctgcttgttacattctgttttggatgggttcttataccagcaatcacatttatcatactgacagtcctaaagttcattgctaatattttccacacaagtaatcaagagaacaggctaaaatcagtacttagaaagataaaggaagagtttgaaaaaacaaaaggctcaatggtatgtgatatctgcaagtatgagtgtgaaacctataaagagttaaaggcacacggggtgtcatgcccccagtctcaatgcccttattgctttactcattgtgaacccacagaagcagcattccaagcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatccatactatgggctgcaagtgcatcagagacaccattgactcctgtctggaatgacaatgcccatggagtaggttctgttcctatgcatacagatttagaacttgatttctctttaacatctagttccaagtatacataccgtaggaagctaacaaacccacttgaagaagcacaatccattgatctacatattgaaatagatgaacaaacaattggtgtggatgttcatgctctaggacactggtttgatggtcgtcttaaccttaaaacatcctttcactgttatggtgcttgtacgaagtatgaatacccttggcatactgcaaagtgccactatgaaagggattaccaatatgagacaagctggggttgtaatccatcagattgtcctggggtgggcacaggctgtacagcatgtggtttatatctagaccgattaaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaagcactggtgcacatccacatgtcaatttggcgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaagaatagagtggaaagaccctgatggaatgctgagggatcatataaacatcttagtaacaaaagacatcgactttgataaccttggtgaaaatccttgcaaaattggcctacaaacatcttccattgagggggcctggggttctggtgtagggtttacattaacatgtctggtatcgctaacagaatgtcctacctttttaacctcaataaaggcttgtgataaggctatctgttatggtgcagagagtgtaacattaacaagagggcaaaatacagtcaaggtatcaggaaaaggtggccatagtggttcaacatttaagtgttgccatggggaggactgttcacaaattggactccatgctgctgcacctcacctagacaaggtcaatgggatttctgagatggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3374 - RNA, 3408 nt, synthetic construct
  misc_feature 1..3408: note = derived and/or modified CDS sequence (wt) from HTNV(Aa14-172)__KU207162.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattgactgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacataagatgatagaagaatcttaccgcagtagaaaatcaataacctgttatgacctatcatgcaataacacttattgcaagccaacattatacatgattgtaccaattcatgcatgcaatatgatgaaaagctgtttgattgcattaggaccatacagagtacaggtagtttatgagagaacctattgcatgacaggagtcctgattgaaggaaagtgttttgtcccagatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtattatcaggtcctggggcatcatgcgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtgcctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcgatggtatgtgatatctgcaagtatgagtgtgaaacctataaagagttgaaggcacatggtgtgtcatgcccccagtctcaatgcccttattgctttactcattgtgaacctacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagacttagaacttgatttctctttaacgtctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggttggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatcaacatgtcaatttggcgacccaggagacattatgagcccaagagacaaaggttttttatgccccgagttcccaggtagtttcaggaagaaatgcaactttgctaccactcctatttgtgagtatgacggaaatatggtctcaggttacaagaaagtaatggcaacaattgattcctttcaatcttttaatacaagcactatgcactttactgatgaaaggatagagtggaaagaccctgatgggatgctgagggatcatataaacatcttagtaacaaaagacatcgactttgataaccttggtgaaaatccttgcaaaattggcctgcaaacatcttccattgagggggcttggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggattgttcgcaaattggactccatgctgctgcacctcacctagacaaggtcaatgggatttctgaggtggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtgaggaagcataaaaagtcatag

SEQ ID NO: 3375 - RNA, 3408 nt, synthetic construct
  misc_feature 1..3408: note = derived and/or modified CDS sequence (wt) from HTNV(Aa14-175)__KU207163.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacacaagatggtagaagaatcttaccgcagtagaaaatcaataacctgttatgacctatcatgcaatagcacttattgcaagccaacactatacatgattgtaccaattcatgcatgcaatatgatgaaaagctgtttgattgcattgggaccatacagagtacaggtagtttatgagagaacctattgcatgacaggagtcctgattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtattatcaggtcctggggcatcatgcgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtgcctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcgatggtatgtgatgtctgcaagtatgagtgtgaaacctataaagagttgaaggcacatggtgtgtcatgcccccagtctcaatgcccttattgctttactcattgtgaacccacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatccacatgtcaatttggcgacccaggagacattatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctgcaaacatcttccattgagggggcttggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggattgttcgcaaattggactccatgctgctgcacctcacctagacaaggtcaatgggatttctgaggtggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtgaggaagcataaaaagtcatag

SEQ ID NO: 3376 - RNA, 3408 nt, synthetic construct
  misc_feature 1..3408: note = derived and/or modified CDS sequence (wt) from HTNV(Aa14-184)__KU207164.1__GP
  source 1..3408: mol_type = other RNA
atggggatatggaagtggctagtgatggccagtttagtatggcctgttttaacactgagaaatgtctatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacataagatgatagaagaatcttaccgcagtagaaaatcaataacctgttatgacctatcatgcaataacacttattgcaagccaacattatacatgattgtaccaattcatgcatgcaatatgatgaaaagctgtttgattgcattaggaccatacagagtacaggtagtttatgagagaacctattgcatgacaggagtcctgattgaaggaaaatgttttgtcccagatcagagtgtggttagtattatcaagcatgggatctttgatatcgcaagtgttcatattgtgtgcttctttgtcgcagttaaagggaatacttataaaatttttgaacaggttaagaaatcctttgaatcaacatgcaatgatacagagaataaagtgcaggggtattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagccaaacatgtattcagccctgggttgttcccaaaacttaatcacacaaattgtgataaaggtgccataccactcatgtggactgggatgattgatttacctggatattatgaggctatccacccctgtacagtattttgtgtattatcaggtcctggggcatcatgcgaggccttttctgaaggcgggattttcaacataacctcccccatgtgcttagtgtcaaagcaaaatcgattccggttaacagaacagcaagtgaattttgtatgtcagcgagtggacgtggacatcgttgtgtactgcaatgggcagagaaaagtaatattgacaaaaactttagttattggacaatgtatatacactataacaagcttattttcattactgcctggggtagcacactctattgctgttgaattgtgtgtgcctggattccatggttgggccacagctgctctgcttgttacattctgttttggatgggttcttataccagcaatcacatttatcatactgacaatcctaaagttcattgctaatattttccacacaagtaaccaagagaacaggttaaaatcagtacttagaaagataaaggaagagtttgaaaaaacaaaaggctcgatggtatgtgatgtctgcaagtatgagtgtgaaacctataaagagttgaaggcacatggtgtgtcatgcccccagtctcaatgcccttattgctttactcattgtgaacctacagaagcagcattccaggcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtgggttctgttcctatgcacacagatttagaacttgatttctctttaacatctagttccaagtatacataccgtaggaagctaacaaacccacttgaagaagcacaatccattgatctacatattgaaatagaagaacaaacaattggtgtggatgtacatgctctaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcctggggtgggcacaggctgtacagcatgtggtttatatctagaccgactgaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatccacatgtcaatttggcgacccaggagacattatgagcccaagagacaaaggttttttatgccccgagttcccaggtagtttcaggaagaaatgcaactttgctaccactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctgcaaacatcttccattgagggggcttggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtgtcaggaaaaggtggccatagtggttcaacatttaagtgttgccatggggaggattgttcgcaaattggactccatgctgctgcacctcacctagacaaggtcaatgggatttctgaggtggaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtgaggaagcataaaaagtcatag

SEQ ID NO: 3377 - RNA, 3408 nt, synthetic construct
  misc_feature 1..3408: note = derived and/or modified CDS sequence (wt) from HTNV(LR1)__AF288293.1__GP
  source 1..3408: mol_type = other RNA
atggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgacacagagaataaagtgcaaggatattatatttgtattgtagggggaaactctgcaccaatatatgttccaacacttgatgatttcagatccatggaagcatttacaggaatcttcagatcaccacatggggaagatcgtgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattccgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatggtctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtggaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattccctgtcccgtaaggaagcataaaaaatcatag

SEQ ID NO: 3378 - RNA, 3408 nt, synthetic construct
  misc_feature 1..3408: note = derived and/or modified CDS sequence (wt) from HTNV(SN7)__AF288656.1__GP
  source 1..3408: mol_type = other RNA
atgggggtatggaagtggctagtaatggccagtttagtctggccagcttgtacactgagaaatgtgtatgacatgaaaattgaatgcccccatacagtcagttttggtgagaatagtgtaattgggtatgtggaattaccccctatgccattagctgatacaacacagttggtgccagaaagctcttgcagtatggacaatcaccagtcattaaataccataacaaaatatacccaggtaagctggagaaagaaggctgatcaggcacagtccagccaaaattcatttgaaacagtatctgttgaggttgaccttaaagggacttgtgttttaaagcacaaaatgatagaagagtcataccgtagcagaaagtcaataacatgttatgacctttcctgcaacagtacctactgcaaacctaccctgtacatgattgtaccaatccatgcatgtaatatgatgaaaagctgtctaattgcactaggcccttacagagtgcaggtggtttatgaaagaacttattgcatgacaggggtcttaatagaaggaaaatgttttgttccagaccaaagtgttgtcagtattattaaacatgggatatttgacattgcaagtgttaaaattgtttgtttctttgtggcagttaagagaaacacttataaactgtttgagcaggttaaaaagtcatttgattctacatgcaatgacactgaaaacaaagtacagggatattacatctgtatcgttggaggaaattcagcacccatatatgtaccaacacttgatgatttcaggtcaatggaggcattctcagggatctttaggtcaccacatggagaagaccatgatctggctggagaagaggttgcttcatattcaattgttggacctgccaatgcaaaagttccacatagtgctagctctgacacgttaagtctaattgcctactcaggaataccatcttattcctcgctcagtatccttacaagctcaacagaggctaaacatgtttttagtcctggattctttccacaacttaatcatacaaagtgtgataaaactgctataccgctaacttggaccgggatgattgatttaccaggatattatgaagctatacacccttgtacagtattttgtgttttgtcaggtcctggggcatcatgtgaggcattttcagaaggtgggattttcaatataacatcccctatgtgcttagtgtcaaaacagaaccgattccggctaacagagcagcaggtcaactttgtgtgtcaaagagtagacatggatattgttgtatactgtaatggccagagaaaagtgatactaactaagacaatggtcattgggcaatgtatatatactataacaagtttattttcactattacctggtgtagcacattcaattgctgttgaattatgtgttccaggcttccatgggtgggcaacagctgcactgcttgtcacattctgctttgggtgggttctcatacctgcagttacatttattatactaacagtcttaaaatttgttgcaaatatctttcacacaagtaaccaagagaacaggcttaaatcagtcctaagaaaaataaaggaagaatttgagaagacaaaaggatcaatggtgtgtgatgtctgtaaatatgagtgtgaaacttataaggaactgaaagcacatggggtttcatgtcctcagtcccaatgcccttactgcttcacccactgtgagcctacagaagctgcattccaggcccattacagagtatgtcaagtaacccacaggtttagggatgacctaaaaaagactgttacacctcaaaacttcacacctggctgttatcggacattaaacttatttaggtataagagtagatgttacatctttactatgtgggtttttctcttagttctggaatctatattgtgggctgcaagtgcatctgaggttcccttgaatcctatatggaatgataatgcacatggagtgggttctgtaccaatgcatacagatctggagcttgacttctcgttaacatcaagttctaaatacacataccgtagaaagctaacaaacccgcttgaggaaacacaagcaattgatcttcatattgaaatagaggaacagacaatcggtgttgatgtacatgctctagggcattggtttgatggtcgtctcaacctaaaaacatcatttcactgctatggggcatgcacaaagtatgaatacccatggcataccgcaaaatgccattacgaaagagattatcagtatgagacaagttggggctgtaacccatcagactgccctggagtaggtacaggctgtacagcatgtggattataccttgaccaactaaaacctgttggtagtgcatacaagattatcacaatcagatatagcaggagagtttgtgtccagtttggtgaagaaaacctttgtaaggttattgatatgaatgactgctttgtgtctagacatgtaaaagtgtgcataattggtacagtttctaagttttctcaaggtgatacactattgttctttggaccacttgagggtggtggtctaatattcaagcactggtgcacatctacatgccagtttggtgaccctggtgatataatgagtccgagagataaaggatttctatgtcctgaattcccaggcagctttaggaaaaagtgcaattttgctactacccctctctgtgagtatgatggaaatatgatctcaggttataagaaagtaatggcaacaattgattcttttcaatcattcaatacaagcaccatgcattttactgatgagcgaattgaatggaaagatcctgatggaatgttacgggatcatataaatattttagtaacaaaggatatagactttgataaccttggagaaaacccttgcaaaattggcttgcaaacatcctccattgaaggagcatggggctctggtgttggtttcacactcacatgtttagtatcattaacagaatgccctacttttctaacttcaattaaagcttgtgacaaagctatctgttatggtgcagagagtgttaccctaacaagagggcagaatacagttaaagtatcagggaagggtggacatagtggatcaacatttaagtgctgtcatggagaagattgttcacagactgggcttcatgctgctgcacctcaccttgataaagtcaatggaatctctgaaagtgaaaatagcaaggtatatgatgatggggctccacagtgtgggataaaatgttggtttgtaaaatctggggagtggatttcaggaatctttagtggcaactggattgtgctcattgtactctgtgtattcctgctattctcattggtattgcttagtgtcctttgtcctgtaagaaagcataaaaaatcatag

SEQ ID NO: 3379 - RNA, 3408 nt, synthetic construct
  misc_feature 1..3408: note = derived and/or modified CDS sequence (wt) from HTNV(84FLi)__AF366569.1__GP
  source 1..3408: mol_type = other RNA
atgggggtatggaagtggctagtaatggccagtttagtctggccagcttgtacactgagaaatgtgtatgacatgaaaattgaatgcccccatacagtcagttttggtgagaatagtgtaattgggtatgtggaattaccccctatgccattagctgatacaacacagttggtgccagaaagctcttgcagtatggacaatcaccagtcattaaataccataacaaaatatacccaggtaagctggagaaagaaggctgatcaggcacagtccagccaaaattcatttgaaacagtatctgttgaggttgaccttaaagggacttgtgttttaaagcacaaaatgatagaagagtcataccgtagcagaaagtcaataacatgttatgacctttcctgcaacagtacctactgcaaacctaccctgtacatgattgtaccaatccatgcatgtaatatgatgaaaagctgtctaattgcactaggcccttacagagtgcaggtggtttatgaaagaacttattgcatgacaggggtcttaatagaaggaaaatgttttgttccagaccaaagtgttgtcagtattattaaacatgggatatttgacattgcaagtgttaaaattgtttgtttctttgtggcagttaagggaaacacttataaactgtttgagcaggttaaaaagtcatttgattctacatgcaatgacactgaaaacaaagtacagggatattacatctgtatcgttggaggaaattcagcacccatatatgtaccaacacttgatgatttcaggtcaatggaggcattctcagggatctttaggtcaccacatggagaagaccatgatctggctggagaagaggttgcttcatattcaattgttggacctgccaatgcaaaagttccacataatgctagctctgacacgttaagtctaattgcctactcaggaataccatcttattcctcgctcagtatccttacaagctcaacagaggctaaacatgtttttagtcctggattctttccacaacttaatcatacaaagtgtgataaaactgctataccgctaacttggaccgggatgattgatttaccaggatattatgaagctatacacccttgtacagtattttgtgttttgtcaggtcctggggcatcatgtgaggcattttcagaaggtgggattttcaatataacatcccctatgtgcttagtgtcaaaacagaaccgattccggctaacaaagcagcaggtcaactttgtgtgtcaaagagtagacatggatattgttgtatactgtaatggccagagaaaagtgatactaactaagacaatggtcattgggcaatgtatatatactataacaagtttattttcactattacctggtgtagcacattcaattgctgttgaattatgtgttccaggcttccatgggtgggcaacagctgcactgcttgtcacattctgctttgggtgggttctcatacctgcagttacatttattatactaacagtcttaaaatttgttgcaaatatctttcacacaagtaaccaagagaacaggcttaaatcagtcctaagaaaaataaaggaagaatttgagaagacaaaaggatcaatggtgtgtgatgtctgtaaatatgagtgtgaaacttataaggaactgaaagcacatggggtttcatgtcctcagtcccaatgcccttactgcttcacccactgtgagcctacagaagctgcattccaggcccattacagagtatgtcaagtaacccacaggtttagggatgacctaaaaaagactgttacacctcaaaacttcacacctggctgttatcggacattaaacttatttaggtataagagtagatgttacatctttactatgtgggtttttctcttagttctggaatctatattgtgggctgcaagtgcatctgaggttcccttgaatcctatatggaatgataatgcacatggagtgggttctgtaccaatgcatacagatctggagcttgacttctcgttaacatcaagttctaaatacacataccgtagaaagctaacaaacccgcttgaggaaacacaagcaattgatcttcatattgaaatagaggaacagacaatcggtgttgatgtacatgctctagggcattggtttgatggtcgtctcaacctaaaaacatcatttcactgctatggggcatgcacaaagtatgaatacccatggcataccgcaaaatgccattacgaaagagattatcagtatgagacaagttggggctgtaacccatcagactgccctggagtaggtacaggctgtacagcatgtggattataccttgaccaactaaaacctgttggtagtgcatacaagattatcacaatcagatatagcaggagagtttgtgtccagtttggtgaagaaaacctttgtaaggttattgatatgaatgactgctttgtgtctagacatgtaaaagtgtgcataattggtacagtttctaagttttctcaaggtgatacactattgttctttggaccacttgagggtggtggtctaatattcaagcactggtgcacatctacatgccagtttggtgaccctggtgatataatgagtccgagagataaaggatttctatgtcctgaattcccaggcagctttaggaaaaagtgcaattttgctactacccctctctgtgagtatgatggaaatatgatctcaggttataagaaagtaatggcaacaattgattcttttcaatcattcaatacaagcaccatgcattttactgatgagcgaattgaatggaaagatcctgatggaatgttacgggatcatataaatattttagtaacaaaggatatagactttgataaccttggagaaaacccttgcaaaattggcttgcaaacatcctccattgaaggagcatggggctctggtgttggtttcacactcacatgtttagtatcattaacagaatgccctacttttctaacttcaattaaagcttgtgacaaagctatctgttatggtgcagagagtgttaccctaacaagagggcagaatacagttaaagtatcagggaagggtggacatagtggatcaacatttaagtgctgtcatggagaagattgttcacagactgggcttcatgctgctgcacctcaccttgataaagtcaatggaatctctgaaattgaaaatagcaaggtatatgatgatggggctccacagtgtgggataaaatgttggtttgtaaaatctggggagtggatttcaggaatctttagtggcaactggattgtgctcattgtactctgtgtattcctgctattctcattggtattgcttagtgtcctttgtcctgtaagaaagcataaaaagtcatag

SEQ ID NO: 3380 - RNA, 3408 nt, synthetic construct
  misc_feature 1..3408: note = derived and/or modified CDS sequence (wt) from HTNV(Aa08-1111)__KY594715.1__GP
  source 1..3408: mol_type = other RNA
atggggatatggaagtggctagtgatggccagtttagtatggcctgtttttacactgagaaatgtctatgacatgaaaattgagtgcccccacacagtaagtttcggggaaaacagtgtgataggttatgtggaattaccccccatgccattggctgacacagcacagatggtgcctgaaagttcctgcagcatggacaatcaccaatcattaaatacaataacaaaatatacccaagtaagttggagaggaaaggctgatcagtcacagtccagtcaaaattcatttgagacagtgtccactgaagttgacttgaagggaacatgtgttctgaaacacaagatggtagaagaatcataccgtagtagaaaatcaataacctgttatgacctatcttgcaatagcacttattgcaagccaacactatacatgattgtaccaattcatgcatgcaatatgatgaaaagctgtttgattgcattgggaccatacagagtacaggtggtttatgagagaacttattgtatgacaggggtcctgattgaaggaaaatgctttgtcccggatcaaagtgtggtcagtattattaagcatgggatctttgatattgcaagtgttcatattgtgtgtttctttgttgcagttaaagggaatacttataaaatctttgaacaggttaaaaaatcctttgaatcaacatgcaatgatacagagaataaagtacaagggtattatatctgtattgtagggggaaactctgcaccaatatatgctccaacacttgatgatttcagatccatggaagcatttacaggaatctttagatcaccacacggggaagaccatgatctggctggggaagaaattgcatcttactctatagtcggacctgccaatgcaaaagttcctcatagtgctagctcagatacattaagcctaattgcctactcaggtataccatcttattcttccctcagcatcataacaagttcaacagaagctaaacatgtattcagccctgggttgttcccaaaacttaatcacacgaattgtaataagggtgccataccactcatatggactgggatgattgatttacctggatactatgaagctgtccatccttgtacagttttttgcgtattatcaggtcctggggcatcatgtgaggccttttctgaaggtgggattttcaacataacctcccccatgtgcttagtgtcaaagcaaaatcgattccggttaacagaacagcaagtgaattttgtgtgccagcgagtagacatggacattgttgtgtactgcaacgggcagagaaaagtaatattaacaaaaacgctagtcattggacaatgtatatatactataacaagcttattctcattactacctggagtagcgcattctattgctgttgaattgtgtgtacctggattccatggttgggccacagctgctctgcttgttacattctgttttggatgggttcttataccagcaatcacattcatcatactaacagttctaaagttcattgctaatatattccacacaagtaaccaagagaacaggctaaaatcagtacttagaaagataaaggaagagtttgaaaaaacaaaaggatcaatggtatgtgatatctgcaagtatgagtgtgaaacctataaagaattaaaggcacacggggtatcatgccctcaatctcaatgtccttactgttttactcattgtgaacccacagaagcagcatttcaagctcattacaaggtatgccaagttactcacagattcagggatgatctaaagaaaactgttactcctcagaacttcacaccaggatgttaccgtacactaaatttatttagatacaaaagtaggtgctacatctttacaatgtggatatttcttcttgtcctagaatctatattgtgggctgcaagtgcatcagaaacaccattaactcctgtctggaatgacaatgcccatggggtaggttctgttcccatgcatacagatctagagcttgatttctctttgacatccagttccaagtacacataccgtaggaagctaacaaacccacttgaggaagcacaatctattggtctacatattgaaatagaagaacaaacaattggtgttgatgtacacgctctaggacactggtttgatggtcgtcttaaccttaaaacatcctttcactgctacggtgcttgtacaaagtatgaatacccttggcatactgcaaagtgccattatgaaagagattaccaatatgagacaagttggggttgtaatccatcagattgtcctggggtgggcacaggctgtacagcatgtggtttatacctagaccaactgaaaccagttggtagtgcttataaaattatcacaataaggtatagcaggagagtctgtgttcaatttggggaggaacacctttgtaagatcatagacatgaatgattgttttgtatctaggcatgttaaggtttgtataattggtacagtatctaagttctctcagggtgatacattattgttttttgggccgcttgaaggtggtggtctaatatttaagcactggtgcacatccacatgtcaatttggtgacccaggagacatcatgagcccaagagacaaaggttttttatgccctgagttcccaggtagttttaggaaaaaatgcaactttgctactacccctatttgtgagtatgatgggaatatggtctcaggttacaagaaagtgatggcaacaattgattcctttcaatcttttaatacaagcactatgcactttactgatgaaaggatagagtggaaagaccctgatggaatgctgagggatcatataaacatcttagtaacaaaggacattgactttgataaccttggtgaaaatccttgcaaaattggcctacaaacatcttctattgagggggcctggggttctggtgtggggttcacattgacatgcctagtatcactaacggaatgtcctacctttttaacctcaataaaggcctgtgataaggctatctgttacggtgcagagagtgtaactctgacaagaggacaaaatacagtcaaggtatcaggaaaaggtggccatagtggttcaacatttaagtgctgccatggggaggaatgctcacaaattggactccatgctgctgcacctcatcttgacaaggtaaatgggatttctgagatagaaaatagtaaagtgtatgatgatggtgccccacaatgtgggattaaatgttggtttgttaaatcaggggaatggatttcaggaatattcagtggtaattggattgtactcattgtcctctgtgtatttctattgttctcattggttttactaagtattctctgtcctgtaaggaagcataaaaaatcataa

SEQ ID NO: 3381 - RNA, 3408 nt, synthetic construct
  misc_feature 1..3408: note = derived and/or modified CDS sequence (wt) from HTNV(Aa09-189)__KY594716.1__GP
  source 1..3408: mol_type = other RNA
atggggatatggaagtggctagtgatggccagtttagtatggcctgtttttacactgagaaatgtctatgacatgaaaattgaatgcccccacacagtaagtttcggggaaaacagtgtgataggttatgtggaattaccccccatgccattggctgacacagcacagatggtgcctgaaagttcctgcagcatggacaatcaccaatcattaaatacaataacaaaatatacccaagtaagttggagaggaaaggctgatcagtcacagtccagtcaaaattcatttgagacagtgtccactgaagttgacttgaagggaacatgtgttctgaaacacaagatggtagaagaatcataccgtagtagaaaatcaataacctgttatgacctatcttgcaatagcacttattgcaagccaacactatacatgattgtaccaattcatgcatgcaatatgatgaaaagctgtttgattgcattgggaccatacagagtacaggtggtttatgagagaacttattgtatgacaggggtcctgattgaaggaaaatgctttgtcccggatcaaagtgtggtcagtattattaagcatgggatctttgatattgcaagtgttcatattgtgtgtttctttgttgcagttaaagggaatacttataaaatctttgaacaggttaaaaaatcctttgaatcaacatgcaatgatacagagaataaagtacaagggtattatatctgtattgtagggggaaactctgcaccaatatatgctccaacacttgatgatttcagatccatggaagcatttacaggaatctttagatcaccacacggggaagaccatgacctggctggggaagaaattgcatcttactctatagtcggacctgccaatgcaaaagttcctcatagtgctagctcagatacattaagcctaattgcctactcaggtataccatcttattcttccctcagcatcataacaagttcaacagaagctaaacatgtattcagccctgggttgttcccaaaacttaatcacacgaattgtgataagggtgccataccactcatatggactgggatgattgatttacctggatactatgaagctgtccatccttgtacagttttttgcgtattatcaggtcctggggcatcatgtgaggccttttctgaaggtgggattttcaacataacctcccccatgtgcttagtgtcaaagcaaaatcgattccggttaacagaacagcaagtgaattttgtgtgccagcgagtagacatggacattgttgtgtactgcaacgggcagagaaaagtaatattaacaaaaacgctagtcattggacaatgtatatatactataacaagcttattctcattactacctggagtagcgcattctattgctgttgaattgtgtgtacctggattccatggttgggccacagctgctctgcttgttacattctgttttggatgggttcttataccagcaatcacattcatcatactaacagttctaaagttcattgctaatatattccacacaagtaaccaagagaacaggctaaaatcagtacttagaaagataaaggaagagtttgaaaaaacaaaaggatcaatggtatgtgatatctgcaagtatgagtgtgaaacctataaagaattaaaggcacacggggtatcatgccctcaatctcaatgtccttactgttttactcattgtgaacccacagaagcagcatttcaagctcattacaaggtatgccaagttactcacagattcagggatgatctaaagaaaactgttactcctcagaacttcacaccaggatgttaccgtacactaaatttatttagatacaaaagtaggtgctacatctttacaatgtggatatttcttcttgtcctagaatctatattgtgggctgcaagtgcatcagaaacaccattaactcctgtctggaatgacaatgcccatggggtaggttctgttcccatgcatacagatctagagcttgatttctctttgacatccagttccaagtacacataccgtaggaagctaacaaacccacttgaggaagcacaatctattggtctacatattgaaatagaagaacaaacaattggtgttgatgtacacgctctaggacactggtttgatggtcgtcttaaccttaaaacatcctttcactgctatggtgcttgtacaaagtatgaatacccttggcatactgcaaagtgccattatgaaagagattaccaatatgagacaagttggggttgtaatccatcagattgtcctggggtgggcacaggctgtacagcatgtggtttatacctagaccaactgaaaccagttggtagtgcttataaaattatcacaataaggtatagcaggagagtctgtgttcaatttggggaggaacacctttgtaagatcatagacatgaatgattgttttgtatctaggcatgttaaggtttgtataattggtacagtatctaagttctctcagggtgatacattattgttttttgggccgcttgaaggtggtggtctaatatttaagcactggtgcacatccacatgtcaatttggtgacccaggagacatcatgagcccaagagacaaaggttttttatgccctgagttcccaggtagttttaggaaaaaatgcaactttgctactacccctatttgtgagtatgatgggaatatggtctcaggttacaagaaagtgatggcaacaattgattcctttcaatcttttaatacaagcactatgcactttactgatgaaaggatagagtggaaagaccctgatggaatgctgagggatcatataaacatcttagtaacaaaggacattgactttgataaccttggtgaaaatccttgcaaaattggcctacaaacatcttctattgagggggcctggggttctggtgtggggttcacattgacatgcctagtatcactaacggaatgtcctacctttttaacctcaataaaggcctgtgataaggctatctgttacggtgcagagagtgtaactctgacaagaggacaaaatacagtcaaggtatcaggaaaaggtggccatagtggttcaacatttaagtgctgccatggggaggaatgctcacaaattggactccatgctgctgcacctcatcttgacaaggtaaatgggatttctgagatagaaaatagtaaagtgtatgatgatggtgccccacaatgtgggattaaatgttggtttgttaaatcaggggaatggatttcaggaatattcagtggtaattggattgtactcattgtcctctgtgtatttctattgttctcattggttttactaagtattctctgtcctgtaaggaagcataaaaaatcataa

SEQ ID NO: 3382 - RNA, 3408 nt, synthetic construct
  misc_feature 1..3408: note = derived and/or modified CDS sequence (wt) from HTNV(CJilin93)__AY748307.1__GP
  source 1..3408: mol_type = other RNA
atggggatgtggaagtggctagtaatagccagtttagtatggcctgctttggcactgagaaatgtgtatgacatgaaaatcgaatgcccccacacagtaagtttcggagaaaacagtgtaatagggtatgtggagttaccccctatgccattggctgacacagcacagatggtgcctgagagttcttgcagcatggataatcatcagtcaataaatactataacaaaatacacccaggtaacctggagaggaaaggcagatccgggacaatccagtcaaaattcattcgaaacattgtctgctgaagttgacttgaaaggaacatgtgttttaaagcataagatggtggaagaatcataccgcagccggaagtcaataacctgttatgacctttcttgtaatagtacttattgcaagccaacattatatatgattgtaccaattcatgcatgtaatatgatgaagagctgtctaattgcattagggccatacagagtgcaggtggtgtatgagaggacctactgtatgacaggagtcttgattgaaggaaaatgttttgtcccagatcaaagtgttgttagcattattaagcatgggatctttgatattgcaagtgttcatattgtatgtttctttgtcgcagttaaggggaacacctataaactctttgaacaggttaagaaatcgtttgagtcaacttgcaatgatactgagaataaagtacaggggtattacatctgtattgtgggaggaaattctgcaccgatctatgtccctacacttgatgatttcaggtccatggaggcttttacgggaatctttaagtcaccacatggagaagaccatgaccttgctggggaggagattgcttcatactctatagttggacctgcaaatgcaaaagtccctcatagtgcaagctcagacacactgagtctaattgcttattcaggtataccatcctattcttccctgagtatcttgacaagttcaacagatgctaagcatgtgtttagccctggattgttcccaaagcttaaccatacaaactgtgataagagtgcaataccacttacatggactgggatgattgatttacctggatactatgaggccatacacccttgcacagttttttgcgtactgtcaggccctggagcatcatgtgaagcattttctgaaggtggaattttcaacataacttcccccatgtgcttagtttcaaagcaaaatcggttccggctaacagaacagcaggtaaactttgtgtgtcaaagagtagacatggacattgttgtgtactgcaatggacagaggaaagtaatattaacaaaaactttagttattgggcaatgtatatatactatcacaagcttgttttcactactacctggggtagcacattctattgctgtggaattatgtgtgcctggattccatggctgggccacagctgctttgcttgttacatactgttttggatgggtccttataccagctatcacatttattatactaacagtcttaaagtttattgctaacatttttcacacaagcaaccaggagaacaggctgaaatcagtattgagaaagataaaggaggagtttgaaaagacaaagggttcaatggtatgtgatgtttgcaagtatgaatgtgaaacctataaagaattaaaggcacatggggtatcttgtccccaatctcaatgcccttactgttttactcattgtgagcctacagaggcagcatttcaagcccactataaagtatgccaggttactcacaggttcagggatgatcttaaaaagactgtcactcctcagaatttcacaccaggttgttatcggacattaaatttatttagatacaaaagtagatgttacatttttacaatgtgggtattccttctcattctggaatctgtactgtgggctgccagtgcatcagaaacaccgctaactcctgtttggaatgataatgcccatggtgttggttctgtgcctatgcacacagatctggagcttgatttttctctgacatccagttctaagtacacataccgcaggaagctaacaaacccactggaggaggcacaatcaattgatctccatattgagatagaagagcaaacaatcggtgttgacgtgcacgctctaggacattggtttgatggccgtcttaacattaaaacatccttccactgttatggtgcttgtacaaagtacgagtacccatggcatactgcaaagtgtcactatgaacgagattaccaatatgagacaagttggggctgtaatccatcagactgccccggggtgggtacaggctgtacagcatgtgggctttatcttgaccagctaaagcctgttggcagtgcatataaaatcattacaataagatatagcagaagagtctgtgttcagtttggagaagaaaacctttgcaaaattatagatatgaatgactgctttgtatctagacatgttaaagtctgtatcattgggacagtttctaagttttcacaaggtgatacactattgtttttcgggccacttgaaggcggtggattgatatttaaacactggtgtacatctacatgtcagtttggtgacccaggagacatcatgagcccaagagacaaaggttttttatgccctgagttcccaggtagttttaggaaaaaatgtaattttgctactactcctatttgtgagtatgatggaaatatggtttcaggctacaaaaaagtgatggcaacaattgactctttccaatccttcaatacaagcactatgcactttactgatgagaggatagaatggaaagaccctgatgggatgttgagggaccatataaatattttagtaacaaaggatattgattttgataatcttggtgaaaacccctgtaaaattggcttgcagacatcttctattgaaggggcatggggttctggtgtaggctttacacttacatgcttggtatcgttaacagagtgtcctacttttttaacctccattaaggcctgtgacaaagccatttgttatggtgcagaaagtgtgacattaacgagaggacaaaatacagtgaaggtatcaggaaaaggtggtcatagtggttcaactttcaaatgttgccatggggaagactgttcaaaaattgggctccatgctgctgcaccccaccttgacaaagttaatgggatctctgaaatagaaaacagtaaagtatatgatgatggagcaccacaatgtggtataaaatgttggtttgtcaaatcaggggaatggatttcagggatatttagtggcaattggattgtgctcattgtcctctgtgtattcttactgttttcattggtcttactcagtattctttgccctgtcaggaagcataaaaaatcatag

SEQ ID NO: 3383 - RNA, 3408 nt, synthetic construct
  misc_feature 1..3408: note = derived and/or modified CDS sequence (wt) from HTNV(KHF,clone:4)__LC209208.1__GP
  source 1..3408: mol_type = other RNA
atggggatatggaagtggctagtgatggccagtttagtatggcctgttttaacactgagaaatgtttatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacacaagatggtagaagaatcttaccgcagtagaaaatcaataacctgttatgacctatcatgcaatagcacttattgcaagccaacactatacatgattgtaccaattcatgcatgtaacatgatgaaaagctgtttgattgcattgggaccatacagagtacaggtagtttatgagagaacctattgcatgacaggagtcctaattgaaggaaaatgttttgtcccagatcagagtgtggttagtattatcaaacatgggatctttgatatcgcaagtgttcatattgtgtgcttctttgtcgcagttaaagggaatacttataaaatttttgaacaggttaagaaatcctttgaatcaacatgcaatgatacagagaataaagtgcagggttattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagctaaacatgtattcagccctgggttgttcccaaaacttaatcacacaaattgtgataaaggtgccataccactcatgtggactgggatgattgatttacctggatactatgaggctatccacccctgtacagtattttgtgtattatcaggacctggggcatcatgtgaggccttttctgaaggcgggattttcaacataacctcccccatgtgcttagtgtcaaagcaaaatcgattccggttaacaaaacagcaagtgaattttgtatgtcagcgagtggatgtggacatcgttgtgtactgcaacgggcagagaaaagtaatattgacaaaaactttagttattggacaatgtatatacactataacaagcttattttcattactgcctggagtagcacactctattgctgtagaattgtgtgtacctggattccatggttgggccacagctgctctgcttgttacattctgttttggatgggttcttataccagcagtaacatttatcatactggcaatcctaaagttcattgctaatattttccacacaagtaaccaagagaacaggctaaaatcagtacttagaaagataaaggaagagtttgaaaaaacaaaaggctcaatggtatgtgatgtctgtaagtatgagtgtgaaacctataaagagttaaaggcacacggggtgtcatgcccccagtctcaatgcccttattgctttactcattgtgaacccacagaagcagcattccaagcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtaggttctattcctatgcacacagatttagaacttgatttctctttaacatctagttccaagtatacataccgcaggaagctaacaaacccacttgaagaagcacaatccattgatctacatattgaaatagaagaacaaacaattggtgtggatgtacatgctttaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcccggggtgggcacaggctgtacagcatgtggtttatatctagaccgactcaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatccacatgtcaatttggtgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctacaaacatcttccattgagggggcctggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcgccaaatggactccatgctgctgcacctcacctagacaaggtcaatgggatttctgagatagaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3384 - RNA, 3408 nt, synthetic construct
  misc_feature 1..3408: note = derived and/or modified CDS sequence (wt) from HTNV(KHF,clone:5)__LC209209.1__GP
  source 1..3408: mol_type = other RNA
atggggatatggaagtggctagtgatggccagtttagtatggcctgttttaacactgagaaatgtttatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacacaagatggtagaagaatcttaccgcagtagaaaatcaataacctgttatgacctatcatgcaatagcacttattgcaagccaacactatacatgattgtaccaattcatgcatgtaacatgatgaaaagctgtttgattgcattgggaccatacagagtacaggtagtttatgagagaacctattgcatgacaggagtcctaattgaaggaaaatgttttgtcccagatcagagtgtggttagtattatcaaacatgggatctttgatatcgcaagtgttcatattgtgtgcttctttgtcgcagttaaagggaatacttataaaatttttgaacaggttaagaaatcctttgaatcaacatgcaatgatacagagaataaagtgcagggttattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagctaaacatgtattcagccctgggttgttcccaaaacttaatcacacaaattgtgataaaggtgccataccactcatgtggactgggatgattgatttacctggatactatgaggctatccacccctgtacagtattttgtgtattatcaggacctggggcatcatgtgaggccttttctgaaggcgggattttcaacataacctcccccatgtgcttagtgtcaaagcaaaatcgattccggttaacagaacagcaagtgaattttgtatgtcagcgagtggatgtggacatcgttgtgtactgcaacgggcagagaaaagtaatattgacaaaaactttagttattggacaatgtatatacactataacaagcttattttcattactgcctggagtagcacactctattgctgtagaattgtgtgtacctggattccatggttgggccacagctgctctgcttgttacattctgttttggatgggttcttataccagcagtaacatttatcatactggcaatcctaaagttcattgctaatattttccacacaagtaaccaagagaacaggctaaaatcagtacttagaaagataaaggaagagtttgaaaaaacaaaaggctcaatggtatgtgatgtctgtaagtatgagtgtgaaacctataaagagttaaaggcacacggggtgtcatgcccccagtctcaatgcccttattgctttactcattgtgaacccacagaagcagcattccaagcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtaggttctattcctatgcacacagatttagaacttgatttctctttaacatctagttccaagtatacataccgcaggaagctaacaaacccacttgaagaagcacaatccattgatctacatattgaaatagaagaacaaacaattggtgtggatgtacatgctttaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcccggggtgggcacaggctgtacagcatgtggtttatatctagaccgactcaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggtgcacatccacatgtcaatttggtgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctacaaacatcttccattgagggggcctggggttctggtgtagggtttacattaacatgtctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcgccaaatggactccatgctgctgcacctcacctagacaaggtcaatgggatttctgagatagaaaatagcaaagtatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3385 - RNA, 3405 nt, synthetic construct
  misc_feature 1..3405: note = derived and/or modified CDS sequence (wt) from HTNV__D00376.1__GP
  source 1..3405: mol_type = other RNA
atggggatatggaagtggctagtgatggccagtttagtatggcctgttttgacactgagaaatgtttatgacatgaaaattgagtgcccccacacagtaagcttcggggaaaatagtgtgataggctatgtggaattaccccccatgccattggctgacacagcacagctggtgcctgagagttcttgcagcatggataatcaccaatcattaaatacaataacaaaatatacccaagtaagttggagaggaaaggctgatcagtcacagtctagccaaaattcatttgagacagtgtctactgaagttgacttgaaaggaacatgtgttctgaaacacaagatggtagaagaatcttaccgcagtagaaaatcaataacctgttatgacctatcatgcaatagcacttattgcaagccaacactatacatgattgtaccaattcatgcatgtaacatgatgaaaagctgtttgattgcattgggaccatacagagtacaggtagtttatgagagaacctattgcatgacaggagtcctaattgaaggaaaatgttttgtcccagatcagagtgtggttagtattatcaaacatgggatctttgatatcgcaagtgttcatattgtgtgcttctttgtcgcagttaaagggaatacttataaaatttttgaacaggttaagaaatcctttgaatcaacatgcaatgatacagagaataaagtgcagggttattatatctgtattgtagggggaaactctgcaccaatatatgttccaacacttgatgatttcagatccatggaagcattcacaggaatctttagatcaccacatggagaagaccatgatctagctggagaagaaactgcaacttactctatagttggacctgccaatgcaaaagttcctcacagtgctagctcagatacattgagcctgattgccttctcaggtataccatcttattcttcccttagcatcctgacaagttcaacagaagctaaacatgtattcagccctgggttgttcccaaaacttaatcacacaaattgtgataaaggtgccataccactcatgtggactgggatgattgatgtacctcgatactatgatggtatccacccctttacagtattttgtgtattatcaggacctggggcatcatgtgaggccttttctgaaggcgggattttcaacataacctcccccatgtgcttagtgtcaaagcaaaatcgattccggttaacagaacagcaggtgaattttgtatgtcagcgagtggatgtggacatcgttgtgtactgcaacgggcagagaaaagtaatattgacaaaaactttagttattggacaatgtatatacactataacaagcttattttcattactgcctggagtagcacactctattgctgtagaattgtgtgtacctggattccatggttgggccacagctgctctgcttgttacattctgttttggatgggttcttataccagcagtaacatttatcatactggcaatcctaaagttcattgctaatattttccacacaagtaaccaagagaacaggctaaaatcagtacttagaaagataaaggaagagtttgaaaaaacaaaaggctcaatggtatgtgatgtctgtaagtatgagtgtgaaacctataaagagttaaaggcacacggggtgtcatgcccccagtctcaatgcccttattgctttactcattgtgaacccacagaagcagcattccaagcccattacaaagtatgccaagttactcacaggttcagggatgatctaaagaaaactgtcactcctcagaacttcacaccaggatgttaccgtacactgaatttatttagatacaaaagtaggtgctacatctttacaatgtggatatttcttcttgtcctagaatctatactatgggctgcaagtgcatcagagacaccattgactcctgtctggaatgacaatgcccatggagtaggttctattcctatgcacacagatttagaacttgatttctctttaacatctagttccaagtatacataccgcaggaagctaacaaacccacttgaagcacaatccattgatctacatattgaaatagaagaacaaacaattggtgtggatgtacatgctttaggacactggtttgatggtcgtcttaaccttaaaacatcctttcactgttatggtgcttgtacaaagtatgaatacccttggcatactgcaaagtgccactatgaaagggattaccaatatgagacaagctggggttgtaatccatcagattgtcccgggtgtggcacaggctgtacagcatgtggtttatatctagaccgactcaaaccagttggcagtgcttataaaatcatcacaataaggtatagcaggagagtctgtgttcaattcggggaggaaaacctttgtaagataatagacatgaatgattgttttgtatctaggcatgttaaggtctgtataattggtacagtatctaaattctctcagggtgatacattattgtttttcggaccacttgaaggtggtggtctaatatttaaacactggcgcacatccacatgtcaatttggtgacccaggagacatcatgagcccaagagacaaaggttttttatgccctgagttcccaggtagtttcaggaagaaatgcaactttgctactactcctatttgtgagtatgacggaaatatggtctcaggttacaagaaagtaatggcaacaattgattcctttcaatcttttaatacaagcactatgcactttactgatgaaaggatagagtggaaagaccctgatggaatgctgagggatcatataaacatcttagtaacaaaagacatcgactttgataaccttggtgaaaatccttgcaaaattggcctacaaacatcttccattgagggggcctggggttctggtgtagggttcacattaacatgtctggtatcactaacagaatgtcctacctttttgacctcaataaaggcttgtgataaggctatctgttacggtgcagagagtgtaacattaacaagaggacaaaatacagtcaaggtatcaggaaaaggtggccatagtggttcaacatttaagtgttgccatggggaggactgttcgccaaatggactccatgctgctgcacctcacctagacaaggtcaatgggatttctgagatagaaaatagcaaagaatatgatgatggagcaccgcaatgtgggataaaatgttggtttgttaaatcaggggaatggatttcagggatattcagtggtaattggattgtactcattgttctctgcgtatttctattgttctcattggttttactgagcattctctgtcccgtaaggaagcataaaaagtcatag

SEQ ID NO: 3386 - RNA, 3417 nt, synthetic construct
  misc_feature 1..3417: note = derived and/or modified CDS sequence (wt) from LANV(510B)__AF005728.1__GP
  source 1..3417: mol_type = other RNA
atggaagggtggttattcaccatcctaggggtctgctacattatgacaactgtgctacccaaaacaatttatgagttgaaaatggaatgtccgcatacagtgggattaggtcaaggctatattataggttctgcagagctgggccttatagatatagcaacagtcccagagataaagcttgaaagctcctgtaattttgatttacatactacatcatctacccaaaaaagctttacacagctggaatggagaaaaaaggctgagacaactgatacaacacaggctgcatcaacaacctttgaagcacaaacaaagacagtaaacatcagaggcacatgcatcctagcatctgatctatatgacacattaaaacgagttaagaaaacagtcctttgttatgatttgacctgtaaccaaacacaatgtcaaccaacagtatacctcatcactcctgttgggacatgtatgtcaatcagaagttgtatggctaaccttttaagcaatagaattcaaattacatttgagaaaacacactgcgttacaggtcagctagttgagggacaatgtttcaatccatcccactcacttactttatcccagccaccacatacatatgatgttgtaacactgcctacaacttgtttttttactgcaaagaaagctgatcaatataagattgttaaaacctttgaaggaatcataagcaagactggctgtacagaaaatagtatccaagggtattatgtctgttttattggaagccactctgagcctttgatcatccccactctagaagatataagatcagcagaattagccagtcgtatgctgctccatccaagaggtgaagatcatgatccactccaaaatgcccaggcagttttaaggattgttgggccaataacagcaaaagttcctagcagtagttcaactgaaactttacaaggcattgcttttgcaggtgttcccatgtatagttctttctcaactcttgtccggaatgctgatcctgaatatgtgttttccccgggtattataccagaatcaaaccaaagtgtgtgtgataaaaagacacttccactcacatggacagggtacttgccaatttctggggaaatggaaaaggtaacaggttgcacagttttttgcacacttgcagggcctggagcaaattgtgaggcatactctgaaagtgggattttcaatatcagttcacctacatgccttgtcaacaaagtacaaagatttcggggttcagaacaaaagattaactttatgtgtcagcgtattgacaacaacgtggtggtttactgtaatggacagaagaaagtcatcctaaccaaaacacttgttattggccagtgcatatacacatttacaagcttgttttcattaatgcctgatgttgcacattcccttgctgttgagctatgtgtacctgggcttcatggctgggctacaatagctttattgtcaaccttttgttttggatggcttctaatccctggcataacactaattgtgcttaagatattaaaaatccttacttattcttgctcacactattcaagtgaatcaaaatttaaaatgatccttgaaaaggttaaagttgaatatcagaaaacaatgggttccatggtttgtgacatatgtcatcatgagtgtgagactgttaaagagcttgagtcacataaacagagctgtgttgaaggtcaatgcccatactgtatgactgtgacagaggcaacccagagtgccctgcaggctcatttttccatctgtaaattgacagggagatttcatgaggccttaaaaaaatctcttaaaaaacctgaggtgcatagagggtgttatcgcacacttggtgtatttagataccgtagtagatgctatgtaggccttgtgtggggttgccttttaaccattgagttagtgctatgggcagcaagtgctgagacaccacttttagaacctggatggtctgacacagcccatggtgttggagagttaccactaaagacagatctagagctagatttttctctaccatcatcttcttcatacagttataggagaaggctaacaaatcctgcaaataaagaggagtcattgccatttcattttcagatggaaaaacaggttattcacgctgaaatacaatctctgggtcattggatggatgctacattcaacatcaaaactgcattccattgttacggagcttgtaaacaatattcttatccttggcaaacagcaaaatgtttttttgaaaaggactatcagtatgaaacaggttggggctgtaaccccggagattgccctggtgttggcacaggttgtactgcctgtgggatttaccttgataagttaaaatcagttggtaaagcctataaggtaatatctttgaaatataccagaaaagtatgtatccagctaggcacagaacaggtatgtaaacatatcgatgcaaatgactgtctagttacaccatcagttaaagtttgtatcataggaacagtatctaagatccaaccgtctgacacattgttgttcttagggcccctagagcaaggtggtgttatattaaagcaatggtgcacaacatcatgtacttttggggatcctggtgatatcatgtctactacatcagggatgaggtgccctgagcacactgggtccttcagaaagatatgtggatttgcaacaactccagtttgtgagtatcaaggtaatactatttcaggatatcaaagactcatggcaacaaaggactcatttcaatcattcaacctgacagatccacacataacatcaagtaaattggaatggatagatccagatggtaataccagagaccatgtaaatctaattttaaatagagatgtgtcctttcaagatttgagtgataacccatgtaaagttgatctacacacccagtccattgacggtgcttggggctctggagtaggattcaccttaacatgtgttgtgggtttaactgaatgtccaagctttatcacttccattaaagcatgtgaccttgcaatgtgctatgggtcaactgttgctaccctagcaaggggttccaacacagttaaagttgttggtaaaggtggacactctggatcttcatttaaatgttgtcatgactctgattgttcatctgagggattaatggcatctgcaccccatcttgagagggtcacagggttcaaccaaatagactcggacaaagtctatgatgacggggccccgccatgctcttttaagtgctggttcactaagtctggtgagtggctccttggaattttaaatggcaattggattgtgattgccgtgctggttatcatcctaataatttcaataatattatttagcttcttatgtccaagacggagtcataagaagaatgtataa

SEQ ID NO: 3387 - RNA, 3402 nt, synthetic construct
  misc_feature 1..3402: note = derived and/or modified CDS sequence (wt) from LQUV(Longquan-Rs-32)__JX465402.1__GP
  source 1..3402: mol_type = other RNA
atgaagtcaatactactaatactactgttggaacaagttagaagcaaggcaacaaatgagatcaagttagaatgccctcatgaccaaagagtcgagactggcttttcacatggctttacagatcttagtccaattctatatacaaaaggtttatttacaaaacatttagaaaataattgtccttttgatatatcaatcatcaatagactagttagagatgttagaatttctacatggcaggctaaatcaacaaatacagatgctactgttgcatctgccacttcattcgaaacaaaagatacagatgataaactagctggtgtttgtggcttttttgatgatataacaaaaccaaaacagggacaaagaaaagcaattatttgctatgatttatcttgtaatcaaacacattgtctcccaacattacatttaatattcccacaacaattttgtcaatcattaaaacagtgttctataaatgcttatgatcacaaaattttgattacaatatctttatcattttgcccagagggtttaattataggaggaaattgtattgtcccagtattagcacagagtcaactattacataatcatatgacctataatattaaggttacatgcttttttgaatatagtatggcaagagaatcattagataataaatttttagaagagatgaaccgtttagttttaggtagaaattgtgagaagactgaatacttagggggttatgtctgttttttggctggatatgggacagcaattcatgtaccttatgataatacatatttaagtggagcagttgtaaatagtatgaaagctaatttacatggagaagatcatgatagactgaaattaggtgatacatcggcagtaatagcaggaaatttgaaatttgttatagatagtactgctccagaaaaaagttatcaaggtgaatgctttacaggacatatgggttatacttctttatatttttacccagtcaggtcaaaagggaaatatgtaacaattttaacaaaaggtgttattccagtaattaataaaacaacatgcatgcctaaaatcgtaccccttgtatggacaggtatggttgagatgagagggatagaagaaaagttggaagcctgtactatgcattgtataatggtaggaaatggtgcaacttgtgaagcattttcagcaacaggcatatttgatataaaatctacaacatgccaaattgggaaaactcataaatatcgtagaacggaagatcagattacattcacttgccaagatttaaacaaagatattagtgttatatgtaatggtgaaaatataacagttccagttaaatctcttattgtaggacaatgtatttacacaattacttcaattttttcaatttttcctgcaactgcccattcaatagcaacagagatgtgtgttcaaggtatccatggatggcttacaataataatattttttacattttgttttggttggttactaatacctatattgacctgcttgataataaacactattgcatatagcttaataacactagcatatttcaagaatggtgcccgactaggaaatttaattaaaagaatgaaaagtgagtttcaacggactataggcaatactacatgtaatatctgtcttagagagtgtgaatcagaatctgaatacaaatcacatgaagaactctgtaaaaatggtagctgtccatattgtatgaaagatattggagtttcacaagttttattaaatgaacattataatgcatgtatgttaattgatagatatgaaaaaagattaactcacacattaaaccaaacccccttatattcaagaaaggttagaaaaatacaaagttttagatacagaaatagatgctttatactaacagtatggatcattttacttactgttgaatcattaatatgggcatctagtgcagaagatataaaaccagcaccaaagtggcaaaatacagctcatggaataggcacaataaaattaaattctgactatgaattagatttttcagtagtagcaggttcagaatttacccataaaagaatgctacagagtccagagtcaggaaagaagaatatacctttcactgtatatctcagtgaacaactaatcactagcacagttcaaattttaggaaattggatggatgcagagattaatgttaaatcagtatttcattgttatggtacatgcaagaagtactcatacccgtggcaatcatcaccatgccataaggaagttgattttgaattccaaagtagttggggctgtaaccctatttcatgtcctggtatcaatagtggttgtacagcatgtgggacatatgtggataaattaaaaacaattgctaaggcttatcggattattacagttaaatactctagaaaagtatgttaccaaataggtacaaaaaaggcatgtaaaacattagagtctaatgactgtttggtatcaaatggtgttaaaatatgtgctataggaacaatctcaacattacaaactggcatgactcttgtattctttggtccattaaatggtggtgccttactcattaaagactggtgtatttcttcatgcaaatttggtgatcctggtgatataatgcaaatatctaataatatcacatgtccctcatttgatggtacaatgcagagagtctgcagatttggtttagaacctatgtgttcatattctggtaataaaatctctggtgtaaagagagtattagaaacaaaagactcatatctttctgtaaacttaacaaaaccaaaattagtaggaagtacattattatggaatagtcttgatagttctattaaagaccatattaatatagtcgtgagcaatgatatagattttgaagatcttgcagagactccctgtaaagtaactattaaaaatcttaaaattgaaggagcatggggttcaggtataggtataaaactacactgtgaagtatcattgtcagaatgttcagaatatttaacaacaataaaagtctgtgacaatgccatatgttatggtgggaatgttgcacatttatcaagaggtctaaatacagttattataaagggagcagggggtcatagtggctcttcctttaagtgttgtcatgagacttcatgttctgatataggttttaaggcagaagcccctcatttggctagaatagtagatgatggaataaccacttcaatgagttattcagatggagctcctgaagcaggaatagtcagttggatctataaagtagctgaatggataaaaggtatgtttaatggaaattggtttgttttaataataatgatactcttccttataatttctattgtccttttaatatttctttgccctgttaaaaaatataaatag

SEQ ID NO: 3388 - RNA, 3402 nt, synthetic construct
  misc_feature 1..3402: note = derived and/or modified CDS sequence (wt) from LQUV(Longquan-Ra-25)__JX465397.1__GP
  source 1..3402: mol_type = other RNA
atgaagtcaatactactaatactactgttgggacaagttagaagcaaggcaacaaatgagatcaagttagaatgccctcatgaccaaagagtcgagactggcttttcacatggctttacagatcttagtccaattctatatacaaaaggtttatttacaaaacatttagaaaataattgtccttttgatatatcaatcatcaatagactagttagagatgttagaatttctacatggcaggctaaatcaacaaatacagatgctactgttgcatctgccacttcattcgaaacaaaagatacagatgataaactagctggtgtttgtggcttttttgatgatataacaaaaccaaaacagggacaaagaaaagcaattatttgctatgatttatcttgtaatcaaacacattgtctcccaacattacatttaatattcccacaacaattttgtcaatcattaaaacagtgttctattaatgcttacgatcacaaaattttgattacaatatctttatcattttgcccagagggtttaattataggaggaaattgtattgtcccagtattagcacagagtcaactattacataatcatatgacctacaatattaaggttacatgcttttttgaatatagtatggcaagagaatcattagataataaatttttagaagagatgaaccgtttagttttaggtagaaattgtgagaagactgaatacttagggggttatgtctgttttttggctggatatgggacagcaattcatgtaccttatgataatacatatttaagtggagcagttgtaaatagtatgaaagctaatttacatggagaagatcatgatagactgaaattaggtgatacatcggcagtaatagcaggaaatttgaaatttgttatagatagtactgctccagaaaaaagttatcaaggtgaatgctttacaggacatatgggttatacttctttatatttttacccagtcaggtcaaaagggaaatatgtaacaattttaacaaaaggtgttattccagtaattaataaaacaacatgcatgcctaaaattgtaccccttgtgtggacaggtatggttgagatgagagggatagaagaaaagttggaagcctgtactatgcattgtataatggtagggaatggtgcaacttgtgaagcattttcagcaacaggcatatttgatataaaatctacaacatgccaaattgggaaaactcataaatatcgtagaacagaagatcaaattacattcacttgtcaagatttaaacaaagatattagtgttatatgtaatggtgaaaatataacagttccagttaaatctctcattgtaggacaatgtatttacacaattacttcaattttttcaatttttcctgcaactgcccattcaatagcaacagagatgtgtgttcaaggtatccatggatggcttacaataataatattttttacattttgttttggttggttactaatacctatattgacctgcttgataataaacactattgcatatagcttaataacactagcatatttcaagaatggtgcacgactaggaaatttaattaaaaggatgaaaagtgagtttcaacggactataggcaatactacatgtaatatctgtcttagagagtgtgaatcagaatctgaatacaaatcacatgaagaactctgtaaaaatggtagctgtccatattgtatgaaagatattggagtttcacaagttttattaaatgaacattataatgcatgtatgttaattgatagatatgaaaaaagattaactcacacattaaaccaaacccccttatattcaagaaaggttagaaaaatacaaagttttagatacagaaatagatgctttatactaacagtatggatcattttacttactgttgaatcattaatatgggcatctagtgcagaagatataaaaccagcaccaaagtggcaaaatacagctcatggaataggcacaataaaattaaattctgactatgaattagatttttcagtagtagcaggttcagaatttacccataaaagaatgctacagagtccagagtcaggaaagaagaatatacctttcactgtatatctcagtgaacaactaatcactagcacagttcaaattttaggaaattggatggatgcagagattaatgttaaatcagtatttcattgttatggtacatgcaagaagtactcatacccgtggcaatcatcaccatgccataaggaagttgattttgaattccaaagtagttggggctgtaaccctatttcatgtcctggtatcaatagtggttgtacagcgtgtgggacatatgtggataaattaaaaacaattgctaaggcttatcggattattacagttaaatactctagaaaagtatgttaccaaataggtacaaaaaaggcatgtaaaacattagagtctaatgactgtttggtatcaaatggtgttaaaatatgtgctataggaacaatatcaacattacaaactggtatgactcttgtattctttggtccattaaatggtggtgccttactcattaaagactggtgtatttcttcatgtaaatttggtgatcctggtgatataatgcaaatatctaataatatcacatgtccctcatttgatggtacaatgcagagagtctgcagatttggtttagaacctatgtgttcatattctggtaataaaatctctggtgtaaaaagagtgttagaaacaaaagactcatatctttctgtaaacttaacaaaaccaaaattagtaggaagtacattattatggaatagtcttgatagttctattaaagaccatattaatatagtcgtgagcaatgatatagattttgaagatcttgcagagactccctgtaaagtaactattaaaaatcttaaaattgaaggagcatggggttcaggtataggtataaaactacactgtgaagtatcattgtcagaatgttcagaatatttaacaacaataaaagtctgtgacaatgccatatgttatggtgggaatgttgcacatttatcaagaggtcttaacacagttattataaagggagcagggggtcatagtggctcttcctttaagtgttgtcatgagacttcatgttctgatataggttttaaggcagaagcccctcatttggctagaatagtagatgatggaataaccacttcaatgagttattcagatggagctcctgaagcaggaataatcagttggatctataaagtagctgaatggataaagggtatgtttaatggaaattggtttgttttaataataatgatactcttccttataatttctattgtccttttaatatttctttgccctgttaaaaaatataaatag

SEQ ID NO: 3389 - RNA, 3402 nt, synthetic construct
  misc_feature 1..3402: note = derived and/or modified CDS sequence (wt) from LQUV(Longquan-Ra-5)__JX465398.1__GP
  source 1..3402: mol_type = other RNA
atgaagtcaatactactaatactactgttgggacaagttagaagcaaggcaacaaatgagatcaagttagaatgccctcatgaccaaagagtcgagactggcttttcacatggctttacagatcttagtccaattctatatacaaaaggtttatttacaaaacatttagaaaataattgtccttttgatatatcaatcatcaatagactagttagagatgttagaatttctacatggcaggctaaatcaacaaatacagatgctactgttgcatctgccacttcattcgaaacaaaagatacagatgataaactagctggtgtttgtggcttttttgatgatataacaaaaccaaaacagggacaaagaaaagcaattatttgctatgatttatcttgtaatcaaacacattgtctcccaacattacatttaatattcccacaacaattttgtcaatcattaaaacagtgttctataaatgcttatgatcacaaaattttgattacaatatctttatcattttgcccagagggtttaattataggaggaaattgtattgtcccagtattagcacagagtcaactattacataatcatatgacctacaatattaaggttacatgcttttttgaatatagtatggcaagagaatcattagataataaatttttagaagagatgaaccgtttagttttaggtaggaattgtgagaagactgaatacttagggggttatgtctgttttttggctggatatgggacagcaattcatgtaccttatgataatacatatttaagtggagcagttgtaaatagtatgaaagctaatttacatggagaagatcatgatagactgaaattaggtgatacatcggcagtaatagcaggaaatttgaaatttgttatagatagtactgctccagaaaaaagttatcaaggtgaatgctttacaggacatatgggttatacttctttatatttttacccagtcaggtcaaaagggaaatatgtaacaattttaacaaaaggtgttattccagtaattaataaaacaacatgcatgcctaaaattgtaccccttgtatggacaggtatggttgagatgagagggatagaagaaaagttggaagcctgtactatgcattgtataatggtaggaaatggtgcaacttgtgaagcattttcagcaacaggcatatttgatataaaatctacaacatgccaaattgggaaaactcataaatatcgtagaacagaagatcagattacattcacttgccaagatttaaacaaagatattggtgttatatgtaatggtgaaaatataacagttccagttaaatctctcattgtaggacaatgtatttacacaattacttcaattttttcaatttttcctgcaactgcccattcaatagcaacagagatgtgtgttcaaggtatccatggatggcttacaataataatattttttacattttgttttggttggttactaatacctatattgacctgcttgataataaacactattgcatatagcttaataacactagcatatttcaagaatggtgcccgactaggaaatttaattaaaagaatgaaaagtgagtttcaacggactataggcaatactacatgtaatatctgtcttagagagtgtgaatcagaatctgaatacaaatcacatgaagaactctgtaaaaatggtagctgtccatattgtatgaaagatattggagtttcacaagttttattaaatgaacattataatgcatgtatgttaattgatagatatgaaaaaagattaactcatacattaaaccaaacccccttatattcaagaaaggttagaaaaatacaaagttttagatacagaaatagatgctttatactaacagtatggatcactttacttactgttgaatcattaatatgggcatctagtgcagaagatataaaaccagcaccaaagtggcaaaatacagctcatggaataggcacaataaaattaaattctgactatgaattagatttttcagtagtagcaggttcagaatttacccataaaagaatgctacagagtccagagtcaggaaagaagaatatacctttcactgtatatctcagtgaacaactaatcactagcacagttcaaattttaggaaattggatggatgcagagattaatgttaaatcagtatttcattgttatggtacatgcaagaagtactcatacccgtggcaatcatcaccatgccataaggaagttgattttgaattccaaagtagttggggctgtaaccctatttcatgtcctggtatcaatagtggttgtacagcatgtgggacatatgtggataaattaaaaacaattgctaaggcttatcggattattacagttaaatactctagaaaagtatgttaccaaataggtacaaaaaaggcatgtaaaacattagagtctaatgactgtttggtatcaaatggtgttaaaatatgtgctataggaacaatctcaacattacaaactggcatgactcttgtattctttggtccattaaacggtggtgccttactcattaaagactggtgtatttcttcatgcaaatttggtgatcctggtgatataatgcaaatatctaataatatcacatgtccctcatttgatggtacaatgcagagagtctgcagatttggtttagaacctatgtgttcatattctggtaataaaatctctggtgtaaagagagtattagaaacaaaagactcatatctttctgtaaacttaacaaaaccaaaattagtaggaagtacattattatggaatagtcttgatagttctattaaagaccatattaatatagtcgtgagcaatgatatagattttgaagatcttgcagagactccctgtaaagtaactattaaaaatcttaaaattgaaggagcatggggttcaggtataggtataaaactacactgtgaagtatcattgtcagaatgttcagaatatttaacaacaataaaagtctgtgacaatgccatatgttatggtgggaatgttgcacatttatcaagaggtctaaatacagttattataaagggagcagggggtcatagtggctcttcctttaagtgttgtcatgagacttcatgttctgatataggttttaaggcagaagcccctcatttggctagaatagtagatgatggaataaccacttcaatgagttattcagatggagctcctgaagcaggaatagtcagttggatctataaagtagctgaatggataaaaggtatgtttaatggaaattggtttgttttaataataatgatactcttccttataatttctattgtccttttaatatttctttgccctgttaaaaaatataaatag

SEQ ID NO: 3390 - RNA, 3402 nt, synthetic construct
  misc_feature 1..3402: note = derived and/or modified CDS sequence (wt) from LQUV(Longquan-Ra-56)__JX465399.1__GP
  source 1..3402: mol_type = other RNA
atgaagtcaatactactaatactactgttgggacaagttagaagcaaggcaacaaatgagatcaagttagaatgccctcatgaccaaagagtcgagactggcttttcacatggctttacagatcttagtccaattctatatacaaaaggtttatttacaaaacatttagaaaataattgtccttttgatatatcaatcatcaatagactagttagagatgttagaatttctacatggcaggctaaatcaacaaatacagatgctactgttgcatctgccacttcattcgaaacaaaagacacagatgataaactagctggtgtttgtggcttttttgatgatataacaaaaccaaaacagggacaaagaaaagcaattatttgctatgatttatcttgtaatcaaacacattgtctcccaacattacatttaatattcccacaacaattttgtcaatcattaaaacagtgttctattaatgcttatgatcacaaaattttgattacaatatctttatcattttgcccagagggtttaattataggaggaaattgtattgtcccagtattagcacagagtcaactattacataatcatatgacctacaatattaaggttacatgcttttttgaatatagtatggcaagagaatcattagataataaatttttagaagagatgaaccgtttagttttaggtagaaattgtgagaagactgaatacttagggggttatgtctgttttttggctggatatgggacagcaattcatgtaccttatgataatacatatttaagtggagcagttgtaaatagtatgaaagctaatttacatggagaagatcatgatagactgaaattaggtgatacatcggcagtaatagcaggaaatttgaaatttgttatagatagtactgctccagaaaaaagttatcaaggtgaatgctttacaggacatatgggttatacttctttatatttttacccagtcaggtcaaaagggaaatatgtaacaattttaacaaaaggtgttattccagtaattaataaaacaacatgcatgcctaaaattgtaccccttgtatggacaggtatggttgagatgagagggatagaagaaaagttggaagcctgtactatgcattgtataatggtaggaaatggtgcaacttgtgaagcattttcagcaacaggcatatttgatataaaatctacaacatgccaaattgggaaaactcataaatatcgtagaacagaagatcagattacattcacttgccaagatttaaacaaagatattagtgttatatgtaatggtgaaaatataacagttccagttaaatctctcattgtaggacaatgtatttacacaatttcttcaattttttcaatttttcctgcaactgcccattcaatagcaacagagatgtgtgttcaaagtatccatggatggcttacaataataatattttttacattttgttttggttggttactaatacctatattgacctgcttgataataaacactattgcatatagcttaataacactagcatatttcaagaatggtgcccgactaggaaatttaattaaaagaatgaaaagtgagtttcaacggactataggcaatactacatgtaatatctgtcttagagagtgtgaatcagaatctgaatacaaatcacatgaagaactctgtaaaaatggtagctgtccatattgtatgaaagatattggagtttcacaagttttattaaatgaacattataatgcatgtatgttaattgatagatatgaaaaaagattaactcacacattaaaccaaacccccttatattcaagaaaggttagaaaaatacaaagttttagatacagaaatagatgctttatactaacagtatggatcattttacttactgttgaatcattaatatgggcatctagtgcagaagatataaaaccagcaccaaagtggcaaaatacagctcatggaataggcacaataaaattaaattctgactatgaattagatttttcagtagtagcaggttcagaatttacccataaaagaatgctacagagtccagagtcaggaaagaagaatatacctttcactgtatatctcagtgaacaactaatcactagcacagttcaaattttaggaaattggatggatgcagagattaatgttaaatcagtatttcattgttatggtacatgcaagaagtactcatacccgtggcaatcatcaccatgccataaggaagttgattttgaattccaaagtagttggggctgtaaccctatttcatgtcctggtatcaatagtggttgtacagcatgtgggacatatgtggataaattaaaaacaattgctaaggcttatcggattattacagttaaatactctagaaaagtatgttaccaaataggtacaaaaaaggcatgtaaaacattagagtctaatgactgtttggtatcaaatggtgttaaaatatgtgctataggaacaatctcaacattacaaactggcatgactcttgtattctttggtccattaaatggtggtgccttactcattaaagactggtgtatttcttcatgcaaatttggtgatcctggtgatataatgcaaatatctaataatatcacatgtccctcatttgatggtacaatgcagagagtctgcagatttggtttagaacctatgtgttcatattctggtaataaaatctctggtgtaaagagagtattagaaacaaaagactcatatctttctgtaaacttaacaaaaccaaaattagtaggaagtacattattatggaatagtcttgatagttctattaaagaccatattaatatagtcgtgagcaatgatatagattttgaagatcttgcagagactccctgtaaagtaactattaaaaatcttaaaattgaaggagcatggggttcaggtataggtataaaactacactgtgaagtatcattgtcagaatgttcaaaatatttaacaacaataaaagtctgtgacaatgccatatgttatggtgggaatgttgcacatttatcaagaggtctaaatacagttattataaagggagcagggggtcatagtggctcttcctttaagtgttgtcatgagacttcatgttctgatataggttttaaggcagaagcccctcatttggctagaatagtagatgatggaataaccacttcaatgagttattcagatggagctcctgaagcaggaatagtcagttggatctataaagtagctgaatggataaaaggtatgtttaatggaaattggtttgttttaataataatgatactcttccttataatttctattgtccttttaatatttctttgccctgttaaaaaatataaatag

SEQ ID NO: 3391 - RNA, 3402 nt, synthetic construct
  misc_feature 1..3402: note = derived and/or modified CDS sequence (wt) from LQUV(Longquan-Ra-90)__JX465400.1__GP
  source 1..3402: mol_type = other RNA
atgaagtcaatactactaatactactgttgggacaagttagaagcaaggcaacaaatgagatcaagttagaatgccctcatgaccaaagagtcgagactggcttttcacatggctttacagatcttagtccaattctatatacaaaaggtttatttacaaaacatttagaaaataattgtccttttgatatatcaatcatcaatagactagttagagatgttagaatttctacatggcaggctaaatcaacaaatacagatgctactgttgcatctgccacttcattcgaaacaaaagacacagatgataaactagctggtgtttgtggcttttttgatgatataacaaaaccaaaacagggacaaagaaaagcaattatttgctatgatttatcttgtaatcaaacacattgtctcccaacattacatttaatattcccacaacaattttgtcaatcattaaaacagtgttctataaatgcttatgatcacaaaattttgattacaatatctttatcattttgcccagagggtttaattataggaggaaattgtattgtcccagtattagcacagagtcaactattacataatcatatgacctacaatattaaggttacatgcttttttgaatatagtatggcaagagaatcattagataataaatttttagaagagatgaaccgtttagttttaggtagaaattgtgagaagactgaatacttagggggttatgtctgttttttggctggatatgggacagcaattcatgtaccttatgataatacatatttaagtggagcagttgtaaatagtatgaaagctaatttacatggagaagatcatgatagactgaaattaggtgatacatcggcagtaatagcaggaaatttgaaatttgttatagatagtactgctccagaaaaaagttatcaaggtgaatgctttacaggacatatgggttatacttctttatatttttacccagtcaggtcaaaagggaaatatgtaacaattttaacaaaaggtgttattccagtaattaataaaacaacatgcatgcctaaaattgtaccccttgtatggacaggtatggttgagatgagagggatagaagaaaagttggaagcctgtactatgcattgtataatggtaggaaatggtgcaacttgtgaagcattttcagcaacaggcatatttgatataaaatctacaacatgccaaattgggaaaactcataaatatcgtagaacagaagatcagattacattcacttgccaagatttaaacaaagatattagtgttatatgtaatggtgaaaatataacagttccagttaaatctctcattgtaggacaatgtatttacacaattacttcaattttttcaatttttcctgcaactgcccattcaatagcaacagagatgtgtgttcaaggtatccatggatggcttacaataataatattttttacattttgttttggttggttactaatacctatattgacctgcttgataataaacactattgcatatagcttaataacactagcatatttcaagaatggtgcccgactaggaaatttaattaaaagaatgaaaagtgagtttcaacggactataggcaatactacatgtaatatctgtcttagagagtgtgaatcagaatctgaatacaaatcacatgaagaactctgtaaaaatggtagctgtccatattgtatgaaagatattggagtttcacaagttttattaaatgaacattataatgcatgtatgttaattgatagatatgaaaaaagattaactcacacattaaaccaaacccccttatattcaagaaaggttagaaaaatacaaagttttagatacagaaatagatgctttatactaacagtatggatcattttacttactgttgaatcattaatatgggcatctagtgcagaagatataaaaccagcaccaaagtggcaaaatacagctcatggaataggcacaataaaattaaattctgactatgaattagatttttcagtagtagcaggttcagaatttacccataaaagaatgctacagagtccagagtcaggaaagaagaatatacctttcactgtatatctcagtgaacaactaatcactagcacagttcaaattttaggaaattggatggatgcagagattaatgttaaatcagtatttcattgttatggtacatgcaagaagtactcatacccgtggcaatcatcaccatgccataaggaagttgattttgaattccaaagtagttggggctgtaaccctatttcatgtcctggtatcaatagtggttgtacagcatgtgggacatatgtggataaattaaaaacaattgctaaggcttatcggattattacagttaaatactctagaaaagtatgttaccaaataggtacaaaaaaggcatgtaaaacattagagtctaatgactgtttggtatcaaatggtgttaaaatatgtgctataggaacaatctcaacattacaaactggcatgactcttgtattctttggtccattaaatggtggtgccttactcattaaagactggtgtatttcttcatgcaaatttggtgatcctggtgatataatgcaaatatctaataatatcacatgtccctcatttgatggtacaatgcagagagtctgcagatttggtttagaacctatgtgttcatattctggtaataaaatctctggtgtaaagagagtattagaaacaaaagactcatatctttctgtaaacttaacaaaaccaaaattagtaggaagtacattattatggaatagtcttgatagctctattaaagaccatattaatatagtcgtgagcaatgatatagattttgaagatcttgcagagactccctgtaaagtaactattaaaaatcttaaaattgaaggagcatggggttcaggtataggtataaaactacactgtgaagtatcattgtcagaatgttcagaatatttaacaacaataaaagtctgtgacaatgccatatgttatggtgggaatgttgcacatttatcaagaggtctaaatacagttattataaagggagcagggggtcatagtggctcttcctttaagtgttgtcatgagacttcatgttctgatataggttttaaggcagaagcccctcatttggctagaatagtagatgatggaataaccacttcaatgagttattcagatggagctcctgaagcaggaatagtcagttggatctataaagtagctgaatggataaaaggtatgtttaatggaaattggtttgttttaataataatgatactcttccttataatttctattgtccttttaatatttctttgccctgttaaaaaatataaatag

SEQ ID NO: 3392 - RNA, 3423 nt, synthetic construct
  misc_feature 1..3423: note = derived and/or modified CDS sequence (wt) from NYV(Rhode Island-1 (RI-1))__U36801.1__GP
  source 1..3423: mol_type = other RNA
atggtagggtgggtttgcatcttccttgtggtccttgctactactacagctgggctgacacgaaacctttatgagttaaaaattgaatgtccacatacagtaggtttaggccaagggtatgtaacaggatcagtggaaacaacacctattctcttgacccaggtaactgatctgaaaattgaaagttcttgtaattttgatttacatgtgccatctacatcaatccagaaatacaaccaggtagaatgggcaaagaaaagttcaaccacagaaagcactagtgcaggtgcaacaacattcgaggccaaaacaaaagaagtgagcttaaagggaacctgcaacatacctgtaactacgtttgaggcagcatataagtcaaggaaaacggttatttgttatgacttggcttgtaatcaaacatattgcctaccaacagtacacctgattgctcctgttcaaacatgcatgtctgtaagaagttgtatgataggtttgctgtcaagccgaatccaagttatttatgagaagacatactgtgttacaggtcaactagtagaaggtctttgtttcattcccactcatacaattgcattgacacaaccaggacatacatatgacacaatgacactgcctatcacttgttttctcgtggcaaagaagttgggaacacaattgaaaatagctgttgaacttgagaagcttatcacagctagcgggtgtacagagaatagctttcaaggttattatatctgttttctgggtaaacattcagagcctttatctgtaccaatgatggacgattataggtctgctgagttattcactcgtatggttttgaacccgagaggtgaagatcatgatccagatcagaatggtcaagggcttatgaggattgctgggcctatcactgcaaaagtgccatccactgagactacagagacgatgcaggggatagcctttgctggtgcacctacgtatagctcgttctcaactttagtaaggaaagcagatcctgactatgtcttctctcctgggataattgcagaatcaaaccatagtgtttgtgataaaaaggctataccccttacatggactggattccttgcagtttcaggggagatagagaagataacaggttgcacagtcttttgtactctagttggacctggagctagttgtaaggcatactcagagacagggatattcaatatcagttcaccgacatgcttagttaataaggttcaaaaattcagggggtcagaacagaggataaattttatgtgccaacgtgttgaccaggatgttatagtatattgtaacggtcaaaagaaagttatcctcactaaaacattaatcattggccagtgcatctatacattcaccagtcttttttctttgattcctggggttgcccactcccttgctgtggagctatgtgtacctggcctgcatggctgggctacagctgcactactaatcaccttttgttttggatggttactaatacctactatcacaatgataatattaaaaatattaaggctccttacattttcctgttcgcattattctacagaatccaagtttaaagcaatccttgaaagggttaaagttgagtaccagaaaacaatgggttcaatggtatgtgatgcgtgtcaccatgagtgtgaaacagcaaaagagctagaaactcataagaaaagctgtcctgaaggtcagtgtccatactgcatgacaatgacagaatccacagagagtgctcttctggctcatttttcaatttgtaagcttacaaataggtttcaggaaaatttaaaaaaatcattaaaacgccctgaagttaaacaaggtcgctatagaacattgggtgtttttagatataagagtaggtgttatgttggtcttgtgtggggggtccttcttacaactgaactcatagtttgggcagctagtgctgacacccctctgatggagtcaggatggtcagacacagctcatggtgtaggtattgtgcctatgaagactgatttggaattagattttgctttagcttcatcatcctcttatagctataggcggaaacttgtgaaccctgctaataaggaagaaaccctgccttttcacttccaactagataagcaggtcgttcatgctgagatacaaaacttaggacactggatggatggcacatttaacatcaagacagcattccactgctatggggagtgtaagaaatatgcatacccatggcagactgccaagtgtttctttgaaaaggattatcaatatgagacaagctggggttgcaatcctccagactgcccaggggtaggaactggctgtactgcttgcggagtgtatttagataaattaagatcaggtggaaaggcttataagattgtttctctcaaatttacaaggaaggtttgtatacagttaggtacagaacaaacctgtaaacatatagatgtgaatgattgtcttgtcacaccatctgtaaaggtttgtttgattggtaccatttcaaaactgcaacccggagatacacttttgtttctaggcccgcttgagcaaggtggaatcattttaaaacaatggtgcacaacatcctgtgtctttggtgatcctggtgatattatgtcaactactacaggtatgaaatgtcctgaacatacaggttcctttaggaaaatttgtggttttgcaaccacaccaacctgtgagtatcaaggtaatactatctcgggatttcagagaatgatggctacaagagactcttttcagtcattcaatgtaacagaaccgcacattaccagtaatcgccttgaatggattgatcctgatagcagtataaaagatcatattaatatggtcttaaaccgagatgtttcatttcaggatttgagtgataatccctgtaaagtggatctacatacgcagtcaattgatggagcttggggctctggggtgggtttcactctggtatgtacagtgggactgactgaatgtgcaaattttatcacttcaatcaaagcatgtgactcagccatgtgttatggggccactgtgacaaatctactaaggggatcgaacacagttaaagtcgtagggaaaggtgggcattctagctcactgtttaaatgctgccatgatactgattgcactgaggagggactagcagcatctccgccccatttagatcgggttactggttataaccagatagattcagacaaagtatatgatgatggggcccctccttgtacaatcaaatgttggttcactaagtcaggtgaatggctcctgggcatattaaatggtaattgggttgttgttgcagtgttgattgtgattctcatattatcaattttactctttagctttttttgcccaataaggggtagaaagaataagtccaactaa

SEQ ID NO: 3393 - RNA, 3423 nt, synthetic construct
  misc_feature 1..3423: note = derived and/or modified CDS sequence (wt) from NYV(New York-1 (NY-1))__U36802.1__GP
  source 1..3423: mol_type = other RNA
atggtagggtgggtttgcatctcccttgtggtccttgctactactacagctgggctgacacgaaacctttatgagttaaaaattgaatgtccacatacagtaggtttaggccaagggtatgtaacaggatcagtggaaacaacacctattctcttgacccaggtaactgatctgaaaattgaaagttcttgtaattttgatttacatgtgccatctacatcaatccagaaatacaaccaggtagaatgggcaaagaaaagttcaaccacagaaagcactagtgcaggtgcaacaacattcgaggccaaaacaaaagaagtgagcttaaagggaacctgcaacatacctgtaactacgtttgaggcagcatataagtcaaggaaaacggttatttgttatgacttggcttgtaatcaaacacattgcctaccgacagtacacctgattgctcctgttcaaacatgcatgtctgtaagaagttgtatgataggtttgctgtcaagccgaatccaagttatttatgagaagacatactgtgttacaggtcaactagtggaaggtctttgtttcattcctactcatacaattgcattgacacaaccaggacatacatatgacacaatgacactgcctatcacttgttttctcgtggcaaagaagttgggaacacaattgaaaatagctgttgaacttgagaagcttatcacagctagcgggtgtacagagaatagctttcaaggttattatatctgttttctgggtaaacattcagagcctttatttgtaccaatgatggacgattacaggtctgctgagttattcactcgtatggttttgaacccgagaggtgaagatcatgatccagatcagaatggtcaagggcttatgaggattgctgggcctatcactgcaaaagtgccatccactgagactacagagacgatgcaggggatagcctttgctggtgcacctatgtatagctcgttctcaactttagtaaggaaagcagatcctgactatgtcttctctcctgggataattgcagaatcaaaccatagtgtttgtgataaaaagactataccccttacatggactggattccttgcagtttcaggggagatagagaagataacaggttgcacagtcttttgtactctagttggacctggagctagttgtgaggcatactcagagacagggatattcaatatcagttcaccgacatgcttagttaataaggttcaaaaattcagggggtcagaacagaggataaattttatgtgccaacgtgttgaccaggatgttatagtatattgtaacggtcagaagaaagttatcctcactaaaacattagtcattggccagtgcatctatacattcaccagtcttttttctttgattcctggggttgcccactcccttgctgtggagctgtgtgtacctggcctgcatggctgggctacaactgcactactaatcaccttttgttttggatggttactaatacctactatcacaatgataatattaaaaatattaaggctccttacattttcctgttcgcactattctacagaatccaagtttaaagcaatccttgaaagggttaaagttgagtaccagaaaacaatgggttcaatggtatgtgatgtgtgtcaccatgagtgtgaaacagcaaaagagctagaaactcataagaaaagctgtcctgaaggtcagtgtccatactgcatgacaatgacagaatccacagagagtgctcttcaggctcatttttcaatttgtaagcttacaaataggtttcaggaaaatttaaaaaaatcacttaaacgccctgaagttaaacaaggatgctatagaacattgggtgtttttagatataagagtaggtgttatgttggtcttgtgtggggggtccttcttacaactgaactcatagtttgggcagctagtgctgacacccctctgatggaatcaggatggtcagacacagctcatggtgtaggtattgtgcctatgaagactgacttggaattagattttgctttagcttcatcatcctcttatagctataggcggaaacttgtgaaccctgctaataaggaagaaaccctgccttttcacttccaactagataagcaggtcgttcatgctgagatacaaaacttaggacactggatggatggcacatttaacatcaagacagcattccactgctatggggagtgtaagaagtatgcatacccatggcagactgccaagtgtttctttgaaaaggattatcaatatgagacaagctggggttgcaatcctccagactgcccaggggtaggaactggctgtactgcttgcggagtgtatttagataaattaagatcagttgggaaggcttataagattgtttctctcaaatttacaaggaaggtttgtatacagttaggtacagaacaaacctgtaaacatatagatgtgaatgattgtcttgtcacaccatctgtaaaggtttgtttgatcggtaccatttcaaaactgcaacccggagatacacttttgtttctaggcccgcttgagcaaggtggaatcattttaaaacaatggtgcacaacatcctgtgtctttggtgaccctggtgatattatgtcaactactacaggtatgaaatgtcctgaacatacaggttcctttaggaaaatttgtggttttgcaaccacaccaacctgtgagtatcaaggtaatactatctcgggatttcagagaatgatggctacaagagactcttttcagtcattcaatgtaacagaaccgcacattaccagcaatcgtcttgaatggattgatcctgatagcagtataaaagatcatattaatatggtcttaaaccgagatgtttcatttcaggatttgagtgataatccctgtaaagtggatctacatacgcagtcaattgatggagcttggggctctggggtaggtttcactctggtatgtacagtgggactgactgaatgtgcaaattttatcacttcaatcaaagcatgtgactcagccatgtgttatggggccactgtgacaaatctactaaggggatcgaacacagttaaagtcgtagggaaaggtgggcattctggctcactgtttaagtgctgccatgatactgattgcactgaggagggactagcagcatctccgccccatttagatcgggttactggttataaccagatagattcagacaaagtatatgatgatggggcccctccttgtacaatcaaatgttggttcactaagtcaggtgaatggctcctgggcatcttaaatggtaattgggttgttgttgcagtgttgattgtgattctcatattatcaattttactctttagctttttttgcccaataaggggtagaaagaataagtccaactaa

SEQ ID NO: 3394 - RNA, 3423 nt, synthetic construct
  misc_feature 1..3423: note = derived and/or modified CDS sequence (wt) from NYV(New York-2 (NY-2))__U36803.1__GP
  source 1..3423: mol_type = other RNA
atggtagggttcgtttgcatcttccttgtggtccttgctactactacagctgggctgacacgaaacctttatgagttaaaaattgaatgtccacatacagtaggtttaggccaagggtatgtaacaggatcagtgggaacaacacctattctcttgacccaggtaactgatctgaaaattgaaagttcttgtaattttgatttacatgtgccatctacatcaatccagaaatacaaccaggtagaatgggcaaagaaaagttcaaccacagaaagcactagtgcaggtgcaacaacattcgaggccaaaacaaaagaagtgagcttaaagggaacctgcaacatacctgtaactacgtttgaggcagcatataagtcaaggaaaacggttatttgttatgacttggcttgtaatcaaacacattgcctaccgacagtacacctgattgctcctgttcaaacatgcatgtctgtaagaagttgtatgataggtttgctgtcaagccgaatccaagttatttatgagaagacatactgtgttacaggtcaactagtggaaggtctttgtttcattcctactcatacaattgcattgacacaaccaggacatacatatgacacaatgacactgcctatcacttgttttctcgtggcaaagaagttgggaacacaattgaaaatagctgttgaacttgagaagcttatcacagctggcgggtgtacagagaatagctttcaaggttattatatctgttttctgggtaaacattcagagcctttatttgtaccaatgatggacgattacaggtctgctgagttattcactcgtatggttttgaacccgagaggtgaagatcatgatccagatcagaatggtcaagggcttatgaggattgctgggcctatcactgcaaaagtgccatccactgagactacagaggcgatgcaggggatagcctttgctggtgcacctatgtatagctcgttctcaactttagtaaggaaagcagatcctgactatgtcttctctcctgggataattgcagaatcaaaccatagtgtttgtgataaaaagactataccccttacatggactggattccttgcagtttcaggggagatagagaagataacaggttgcacagtcttttgtactctagttggacctggagctagttgtgaggcatactcagagacagggatattcaatatcagttcaccgacatgcttagttaataaggttcaaaaattcagggggtcagaacagaggataaattttatgtgccaacgtgttgaccaggatgttatagtatattgtaacggtcagaagaaagttatcctcactaaaacattagtcattggccagtgcatctatacattcaccagtcttttttctttgattcctggggttgcccactcccttgctgtggagctgtgtgtacctggcctgcatggctgggctacaactgcactactaatcaccttttgttttggatggttactaatacctactatcacaatgataatattaaaaatattaaggctccttacattctcctgttcgcactactctacagaatccaagtttaaagcaatccttgaaagggttaaagttgagtaccagaaaacaatgggttcaatggtatgtgatgtgtgtcaccatgagtgtgaaacagcaaaagagctagaaactcataagaaaagctgtcctgaaggtcagtgtccatactgcatgacaatgacagaatccacagagagtgctcttcaggctcatttttcaatttgtaagcttacaaataggtttcaggaaaatctaaaaaaatcacttaaacgccctgaagttaaacaaggatgctatagaacattgggtgtttttagatataagagtaggtgttatgttggtcttgtgtggggggtccttcttacaactgaactcatagtttgggcagctagtgctgacacccctctgatggaatcaggatggtcagacacagctcatggtgtaggtattgtgcctatgaagactgacttggaattagattttgctttagcttcatcatcctcttatagctataggcggaaacttgtggaccctgctaataaggaagaaaccctgccttttcacttccaactagataagcaggtcgttcatgctgagatacaaaacttaggacactggatggatggcacatttaacatcaagacagcattccactgctatggggagtgtaagaaatatgcatacccatggcagactgccaagtgtttctttgaaaaggattatcaatatgagacaagctggggttgcaatcctccagactgcccaggggtaggaactggctgtactgcttgcggagtgtatttagataaattaagatcagttggaaaggcttataagattgtttctctcaaatttacaaggaaggtttgtatacagttaggtacagaacaaacctgtaaacatatagatgtgaatgattgtcttgtcacaccatctgtaaaggtttgtttgatcggtaccatttcaaaactgcaacccggagatacacttttgtttctaggcccgcttgagcaaggtggaatcattttaaaacaatggtgcacaacatcctgtgtctttggtgaccctggtgatattatgtcaactactacaggtatgaaatgtcctgaacatacaggttcctttaggaaaatttgtggttttgcaaccacaccaacctgtgagtatcaaggtaatactatctcgggatttcagagaatgatggctacaagagactcttttcagtcattcaatgtaacagaaccgcacattaccagtaatcgtcttgaatggattgatcctgatagcagtataaaagatcatattaatatggtcttaaaccgagatgtttcatttcaggatttgagtgataatccctgtaaagtggatctacatacgcagtcaattgatggagcttggggctctggggtaggtttcactctggtatgtacagtgggactgactgaatgtgcaaattttatcacttcaatcaaagcatgtgactcagccatgtgttatggggccactgtgacaaatctactaaggggatcgaacacagttaaagtcgtagggaaaggtgggcattctggctcactgtttaaatgctgccatgatactgattgcactgaggagggactagcagcatctccgccccatttagatcgggttactggttataaccagatagattcagacaaagtatatgatgatggggcccctccttgtacaatcaaatgttggttcactaagtcaggtgaatggctcctgggcatcttaaatggtaattgggttgttgttgcagtgttgattgtgattctcatattatcaattttactctttagctttttttgcccaataaggggtagaaagaataagtccaactaa

SEQ ID NO: 3395 - RNA, 3447 nt, synthetic construct
  misc_feature 1..3447: note = derived and/or modified CDS sequence (wt) from PUUV(K27)__L08754.1__GP
  source 1..3447: mol_type = other RNA
atgggagaacttagtccagtttgtctgtatctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 3396 - RNA, 3447 nt, synthetic construct
  misc_feature 1..3447: note = derived and/or modified CDS sequence (wt) from PUUV(13891)__U22418.1__GP
  source 1..3447: mol_type = other RNA
atgggaaaaattattccagtttgtctgtacttgctcttcttgtgtctgctactatggaatagaggagatgccagaaacctaaatgaacttaaaatggagtgtccacacacaattggtttgggtcagggcctagttattggatcagttgaattaccacctgttccattaacacaggtggagtctttaaaactggaaagttcatgtaattttgatctacataccagtacatcatcacaacagtcattcacaaaatggacatgggagataaaaaatgacctggcagaaaatacacaggcatcatctacaagttttcaaacaaagagcagtgaaataaacttacgaggtttatgtttgattcctccattggtgattgagactgctgcaagaacccgaaaaacaatagcatgttttgatttgtcttgtaatcagacagcatgccagcctactgtttttctaataggcccaatacaaacatgcataacaacaaaaagttgccttttaggtttaggtgatcagagaattcaagttaattatgaaaaaacatattgtgtttcaggtcagcttgttgaaggtgtctgttttaatccagtacatactatggcattatctcaacccagccatacatatgatatagtgacagtgatggtgcgttgttttttaattgtaaagaaggtttcaacaggtgatagtatgaagcttgaaaaaagctttgagactcttgttcagaaaactggttgtacaggcaatggttttcaaggttattatgtctgtttggtaggaagcagttctgagccactatatattcctacattggatgattacaggtcagctgagatcctctcaagaatggcatttgcaccacatggggaagatcatgatgttgaaaagaatgctattagtgcaatgagaattgttgggaaagtgacaggcaaagcaccatcaactgagtcatctgatacaatacagggcattgccttttcaggtaaccctctttatacatcaactggggtcttaacagcaaaggatgatcctgtatacatttgggcacctggaattataatggaaggaaaccactctgtttgtgacaaaaaaacactgcccctcacatggactggtttcataccattaccaggagaaattgagaagacaacacagtgtacagtattctgtacattagctggacctggtgcagattgtgaagcatattctgaaacagggatattcaacataagttctccaacctgcttaattaaccgtgtgcagagattccgtggtgctgaacagcaaatcaaattcatttgtcagagggttgatatggacattacagtatactgtaacggtttgaagaaagtgattcttaccaaaactttagtcattggacagtgtatttatacttttacaagcattttctctttaatccctggagttgctcactcactagctgtagaattatgtgtgccaggtctccatggttgggccacgatgctacttttattaacattttgctttgggtggatcttaataccatttttttctatgatattattaaaaattctaattgcatttgcttacttatgctcaaagtataatacagactcaaagtttaaaatactaatagagaaggttaaaagagaatatcaaaaaactatgggctccatggtatgtgaggtttgtcaatatgagtgtgaaactgcaaaggaactagagtcacacaggaaaagttgcccaataggttcatgtccatattgtctgaatcctgctgaagcaacaacatctgctttacaggcccattttaaggtgtgtaaactcacatcaaggtttcaggacaatctaaggaagtcattaggggcatatgaacccaaacagggttgttacaggacattgtctctttttcgctatagaagcaggttttttgtgggttttaattggtgtttgttgttagttttggaattaattgtgtgggctgctagtgctgaaactcaaagtttaaattctggatggacagatacagcacatggatctggaataatacctatgagaactgaccttgaactagatttttctcttccatcttctgcaagttatacatacagaagacagttacaaaatccagcaaatgagcaagaaaaaataccattccacttgcaaataagtaaacaggtaattcatgcagaaattcaacatttaggtcactggatggatggcacatttaacttaaaaactgcatttcactgttatggctcttgtgaaaagtatgcatatccttggcaaacagcaggttgttttatagaaaaagattatgagtatgaaagtggctggggatgtaacccacctgattgtccaggggtaggaactgggtgtacagcctgtggtgtgtatttagataagctaaaatccgtgggtaaagcattcaaaattgtgtctttgaggtacacaaggaaagcatgtatccaacttggcactgaacaaacttgcaaaagtgtagatagtaatgattgcttggtgactacatcagtcaaggtatgtttaattggaactgtgtcaaaatttcaaccatcagatactctattatttttaggtccacttgaacaaggtgggttgatttttaagcaatggtgtactacaacatgtcaattcggtgatccaggggatataatgagcactccggtagggatgaagtgccctgaattgagcggttcattcagaaaaaaatgtgcatttgcaacaacgcctgtttgtcaatttgatgggaatactctttctgggtacaaaagaatgattgcaacaaaggattcatttcaatcattcaatgttacagaaccccatatttctgcaagctcacttgaatggattgaccctgatagttctttgagagatcatattaatgttattgtaggccgtgatctctcttttcaagacctgagtgaaacaccctgtcaagtagatttagcaacaacatcaattgatggggcatggggttcaggagtgggttttaacttagtttgttctgtgagcctgacagagtgttctacatttttaacttcaatcaaggcatgtgactcagcaatgtgttatggttctacaacagccaatcttctaagagggcagaatacagttcatattgtgggaaaaggtggacattctgggtctaaatttatgtgttgtcatgatacgaagtgctcaagtactgggttggttgcagctgcaccacacttggatcgtgtgacaggatataaccaagcagatagtgataagatctttgatgatggtgcccctgaatgtggtatatcttgctggttcacaaaatcaggagaatggattcttggagttttgaatggaaactggatggtagtggctgtactaatagcattattcatattctccatcttcctctttacattgtgttgtccacgaaggcctagttatgcaaaagaacataaaccttaa

SEQ ID NO: 3397 - RNA, 3447 nt, synthetic construct
  misc_feature 1..3447: note = derived and/or modified CDS sequence (wt) from PUUV(CG17/Baskiria-2001)__AF442614.1__GP
  source 1..3447: mol_type = other RNA
atgggagaacttagtccagtttgtctgtatctgcttctccagggtctattactatgtaatacaggggctgccagaaaccttaatgagcttaaaatggaatgtccacatactattggattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagtagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcttgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccttatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcaccatcaacagaatcatcagatacagtacaggggattgcattttcaggtagtcctctttatacatctactggtgtcttgacatcaaaagatgatcctgtctacatttgggctcctggaatcatcatggaaggaaaccattctatttgtgaaaagaagaccttaccccttacatggactggttttatttcattgcctggagagattgaaaagacaacacaatgtacagtattttgtacattggctggaccaggtgcagattgtgaagcttattctgaaacaggcatcttcaacataagttcacctacttgcttaataaatcgtgtccagagattccgtggtgcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacattttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgctccattggttcatgcccttattgtctcaatccatctgaggcaacaacatctgcccttcaggctcattttaaagtgtgtaagctaacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcacctgcagttaagcaaacaagtgatccatgcagaaatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgatactttgctatttctaggtccactacagcagggtggtctgatatttaaacaatggtgcactacaacatgtcagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgttggtaagggtgggcattctggttcaaaatttatgtgttgtcatgacacaaaatgttctagcactggtctagttgcagctgcaccacacttagatcatgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 3398 - RNA, 3447 nt, synthetic construct
  misc_feature 1..3447: note = derived and/or modified CDS sequence (wt) from PUUV(CG215/Omsk)__AF442615.1__GP
  source 1..3447: mol_type = other RNA
atgggaaaacttagtccagtttgtttgtatctacttctccagtgtctactactaggggatagaggggatgccaggaacctgaatgagcttaaaatggagtgcccacatactatcggattaggtcaaggcctggttgttggttcagtggaattaccaccagttcccatacagcaggttgagtctttaaagctggaaagttcttgtaattttgatttacataccagtacagcaggacaacagtcatttacaaaatggacatgggagataaagaatgatttggctgaaaacacgcaagcatcatcaacaagtttccagacaaaaagcagtgaggtaaatttaagaggattatgcctgataccaacattagtggttgaaacagctgcaaggactcggaagacaatagcctgctacgatctaacatgcaatcagacagtatgccagcccactgtctacttaatgggaccaatccagacttgtgtaacaacaaaaagctgtctcttgggtttaggtgatcaaaggattcaagtgaattatgagaagacatattgtgtgtcagggcaacttgttgaaggtgtctgttttaatcctatccatacaatggccctttctcaaccaagtcatacatatgatgtaatgacattgatggtgcgttgtttcttaattataaaaaaagtaacatcaggtgatagtatgaagattgaaaaaaactttgaaactcttgtccaaaaaacaggctgtacaggtaataactttcagggttattatatctgtcttataggaagtagctctgagccattgtatgtcccaacattggatgattaccggtcagctgaggtattatcaaggatggcctttgcccctcacggagaagatcatgatattgagaaaaatgctgtaagtacaatgaggattgctggtaaagtgacaggtagggcaccttcaactgaggcctctgatacagtgcaaggtattgctttttcaggtagtcctctttatacatctacaggggttttgacagccaaagatgaccctgtatatatttgggcaccaggaattatcatggagggtaaccattctagttgtgataaaaagacattgccattgacatggacaggctttatttcattaccaggagaaatagaaaaaacaacacaatgtacagtcttttgtaccttggctggaccaggggctgattgcgaggcttattctgagacaggtatttttaatataagttcacctacatgtttaattaatcgtgtgcaaaggttccgtggtgcggagcaacagataaagtttgtctgtcaaagagttgacatggatattattgtatattgtaacggcataaagaaagtaatactaacaaaaacattggttataggacaatgcatttatacattcactagtattttttcattaatcccaggagttgctcactctttagctgttgaattgtgtgtaccgggtcttcatggttggactactatgttgctcttattaactttttgttttggttgggtattaataccatttatcaccatgatactactgaaaatactaattgcatttgcatatctttgttccaaatacaacacagattctaagttcagaattctggttgagaaagtcaagaaagaataccagaaaacaatgggttcaatggtatgtgaggtttgtcaatatgagtgtgaaactgccaaggaactagagtcacatcggaaaagctgttcaattggatcatgcccatattgcctgaatccatctgaggctacaacatctgcccttcaagctcattttaaagtatgtaaactaacatcaaggtttcaggaaaacttaaggaaatcattaacagtctatgaaccaatgcagggctgttatcggactttgtcactcttccgatatagaagtaaattctttgtgggcttggtctggtgcttattattggttatggagctgattgtgtgggcagccagtgcagaaacacaaaatttaaattctgggtggactgacacagcacatggatctgggatcataccaatgaaaactgacctggaattagacttctccctaccatcctctgcaagttacacatataggaggcagttacaaaatccagcaaatgaacaagaaaaaataccatttcatttgcagataagtaaacaagtgattcatgcagaaattcaacatttaggccattggatggatgctacatttaatctaaagacagcattccattgctatggatcttgtgaaaagtatgcttacccttggcagacagcaggttgtttcattgaaaaggactatgagtatgagactggttggggttgcaatccacctgattgccctggggttggtacaggatgtactgcatgtggtgtttatttagataagttaaaatcagttgggaaagtatttaagattgtatcccttaaatatactagaaaggtatgcatccaattaggcactgaacagacctgtaaaactgttgatagtaatgattgtctaatcactacatctgttaaggtgtgcatgattgggactatttcaaaatttcaaccctctgatactttattatttctaggtcctctgcaacaaggtggcttaatctttaaacaatggtgcacaacaacatgtcagtttggggatcctggagatattatgagcacacctacaggaatgaaatgtccagaattaaatggttcattcaggaaaaaatgtgcatttgcaacgacacctgtatgccaatttgatgggaatacaatttcaggatataaacggatgattgcaacaaaagattctttccaatcttttaatgtgacagaacctcacatttctgccagtgcattggaatggatagatcctgatagctcactacgagaccatatcaatgtagttgtaggtcgtgatctatctttccaggatctcagtgaaacaccctgtcaggtggatttaatgacttcaactatagatggggcatggggttcaggagttggattcaatcttgtctgtactgttagcttaacagagtgttcaccatttttaacttccatcaaagcttgtgattcagctatgtgttatggatcaactactgttaatttggtgagaggtcagaatacagttcatattgttggtaagggaggtcactctggttcaaaattcatgtgttgtcatgacactaaatgttcaagcacaggcttagttgcagctgcaccacatctagatcgtgttacaggctataatcaagcagatagtgataagatatttgatgatggtgcacctgaatgtggtatgtcatgctggtttaaaaaatcaggagaatggatactcggagtgctcaacggaaattggatggttgttgctgtactaattgccctattaatattatccattcttatgttcacattgtgctgtccacgtaggcctagctacaggaaagagcataagccatga

SEQ ID NO: 3399 - RNA, 3447 nt, synthetic construct
  misc_feature 1..3447: note = derived and/or modified CDS sequence (wt) from PUUV(CG222/Omsk)__AF442616.1__GP
  source 1..3447: mol_type = other RNA
atgggaaaacttagtccagtttgtttgtatctacttctccagtgtctactactaggggatagaggggatgccaggaacctgaatgagcttaaaatggagtgcccacatactatcggattaggtcaaggcctggttgttggttcagtggaattaccaccagttcccatacagcaggttgagtctttaaagctggaaagttcttgtaattttgatttacataccagtacagcaggacaacagtcatttacaaaatggacatgggagataaagaatgatttggctgaaaacacgcaagcatcatcaacaagtttccagacaaaaagcagtgaggtaaatttaagaggattatgcctgataccaacattagtggttgaaacagctgcaaggactcggaagacaatagcctgctacgatctaacatgcaatcagacagtatgccagcccactgtctacttaatgggaccaatccagacttgtgtaacaacaaaaagctgtctcttgggtttaggtgatcaaaggattcaagtgaattatgagaagacatattgtgtgtcagggcaacttgttgaaggtgtctgttttaatcctatccatacaatggccctttctcaaccaagtcatacatatgatgtaatgacattgatggtgcgttgtttcttaattataaaaaaagtaacatcaggtgatagtatgaagattgaaaaaaactttgaaactcttgtccaaaaaacaggctgtacaggtaataactttcagggttattatatctgtcttataggaagtagctctgagccattgtatgtcccaacattggatgattaccggtcagctgaggtattatcaaggatggcctttgcccctcacggagaagatcatgatattgagaaaaatgctgtaagtacaatgaggattgctggtaaagtgacaggtagggcaccttcaactgaggcctctgatacagtgcaaggtattgctttttcaggtagtcctctttatacatctacaggggttttgacagccaaagatgaccctgtatatatttgggcaccaggaattatcatggagggtaaccattctagttgtgataaaaagacattgccattgacatggacaggctttatttcattaccaggagaaatagaaaaaacaacacaatgtacagtcttttgtaccttggctggaccaagggctgattgcgaggcttattctgagacaggtatttttaatataagttcacctacatgtttaattaatcgtgtgcaaaggttccgtggtgcggagcaacagataaagtttgtctgtcaaagagttgacatggatattattgtatattgtaacggcataaagaaagtaatactaacaaaaacattggttataggacaatgcatttatacattcactagtattttttcattaatcccaggagttgctcactctttagctgttgaattgtgtgtaccgggtcttcatggttggactactatgttgctcttattaactttttgttttggttgggtattaataccatttatcaccatgatactactgaaaatactaattgcatttgcatatctttgttccaaatacaacacagattctaagttcagaattctggttgagaaagtcaagaaagaataccagaaaacaatgggttcaatggtatgtgaggtttgtcaatatgagtgtgaaactgccaaggaactagagtcacatcggaaaagctgttcaattggatcatgcccatattgcctgaatccatctgaggctacaacatctgcccttcaagctcattttaaagtatgtaaactaacatcaaggtttcaggaaaacttaaggaaatcattaacagtctatgaaccaatgcagggctgttatcggactttgtcactcttccgatatagaagtaaattctttgtgggcttggtctggtgcttattattggttatggagctgattgtgtgggcagccagtgcagaaacacaaaatttaaattctgggtggactgacacagcacatggatctgggatcataccaatgaaaactgacctggaattagacttctccctaccatcctctgcaagttacacatataggaggcagttacaaaatccagcaaatgaacaagaaaaaataccatttcatttgcagataagtaaacaagtgattcatgcagaaattcaacatttaggccattggatggatgctacatttaatctaaagacagcattccattgctatggatcttgtgaaaagtatgcttacccttggcagacagcaggttgtttcattgaaaaggactatgagtatgagactggttggggttgcaatccacctgattgccctggggttggtacaggatgtactgcatgtggtgtttatttagataagttaaaatcagttgggaaagtatttaagattgtatcccttaaatatactagaaaggtatgcatccaattaggcactgaacagacctgtaaaactgttgatagtaatgattgtctaatcactacatctgttaaggtgtgcatgattgggactatttcaaaatttcaaccctctgatactttattatttctaggtcctctgcaacaaggtggcttaatctttaaacaatggtgcacaacaacatgtcagtttggggatcctggagatattatgagcacacctacaggaatgaaatgtccagaattaaatggttcattcaggaaaaaatgtgcatttgcaacgacacctgtatgccaatttgatgggaatacaatttcaggatataaacggatgattgcaacaaaagattctttccaatcttttaatgtgacagaacctcacatttctgccagtgcattggaatggatagatcctgatagctcactacgagaccatatcaatgtagttgtaggtcgtgatctatctttccaggatctcagtgaaacaccctgtcaggtggatttaatgacttcaactatagatggggcatggggttcaggagttggattcaatcttgtctgtactgttagcttaacagagtgttcagcatttttaacttccatcaaagcttgtgattcagctatgtgttatggatcaactactgttaatttggtgagaggtcagaatacagttcatattgttggtaagggaggtcactctggttcaaaattcatgtgttgtcatgacactaaatgttcaagcacaggcttagttgcagctgcaccacctctagatcgtgttacaggctataatcaagcagatagtgataagatatttgatgatggtgcacctgaatgtggtatgtcatgctggtttaaaaaatcaggagaatggatactcggagtgctcaacggaaattggatggttgttgctgtactaattgccctattaatattatccattcttatgttcacattgtgctgtccacgtaggcctagctacaggaaagagcataagccatga

SEQ ID NO: 3400 - RNA, 3447 nt, synthetic construct
  misc_feature 1..3447: note = derived and/or modified CDS sequence (wt) from PUUV(CRF161)__AF367061.1__GP
  source 1..3447: mol_type = other RNA
atgggaaaacttagtccagtttgtttgtatctacttctccagtgtctactactaggggatagaggggatgccaggaacctgaatgagcttaaaatggagtgcccacatactatcggattaggtcaaggcctggttgttggttcagtggaattaccaccagttcccatacagcaggttgagtctttaaagctggaaagttcttgtaactttgatttacataccagtacagcaggacaacagtcatttacaaaatggacatgggagataaagaatgatttggttgaaaacacgcaagcatcatcaacaagtttccagacaaaaagcagtgaggtaaatttaagaggattatgcctgataccaacattagtggttgaaacagctgcaaggactcggaagacaatagcctgctacgatctaacatgcaatcagacagtatgccagcccactgtctacttaatgggaccaatccagacttgtataacaacaaaaagctgtctcttgggtttaggtgatcaaaggattcaagtgaattatgagaagacatattgtgtgtcagggcaacttgttgaaggtgtctgttttaatcctatccatacaatggccctttctcaaccaagtcatacatatgatgtaatgacattgatggtgcgttgtttcttaattataaaaaaagtaacatcaggtgatagtatgaagattgaaaaaaactttgaaactcttgtccaaaaaacaggctgtacaggtaataactttcagggttattatatctgtcttataggaagtagctctgagccattgtatgtcccaacattggatgattaccggtcagctgaggtattatcaaggatggcctttgcccctcacggagaagatcatgatattgagaaaaatgctgtaagtacaatgaggattgctggtaaagtggcaggtagggcaccttcaactgaggcctctgatacagtgcaaggtattgctttttcaggtagtcctctttatacatctacaggggttttgacagccaaagatgaccctgtatatatttgggcaccaggaattatcatggagggtaaccattctagttgtgataaaaagacattgccattaacatggacaggctttatttcattaccaggagaaatacaaaaaacaacacaatgtacagtcttttgtaccttggctggaccacgggctgattgccaagcttattctgagacaggtatttttaatataagttcacctacatgtttaattaatcgtgtgcaaaggttccgtggtgcggagcaacagataaagtttgtctgtcaaagagttgacatggatattattgtatattgtaacggcataaagaaagtaatactaacaaaaacattggttataggacaatgcatttatacattcactagtattttttcattaatcccaggagttgctcactctttagctgttgaattgtgtgtaccgggtcttcatggttggactactatgttgctcttattaactttttgttttggttgggtattaataccatttatcaccatgatactactgaaaatactaattgcatttgcatatctttgttccaaatacaacacagattctaagtttagaattctggttgagaaagtcaagaaagaataccagaaaacaatgggttcaatggtatgtgaggtttgtcaatatgaatgtgaaactgccaaggaactagagtcacatcggaaaagctgttcaattggatcatgcccatattgcctgaatccatctgaggctacaacatctgcccttcaagctcattttaaagtatgtaaactaacatcaaggtttcaggaaaacttaaggaaatcattaacagtctatgaaccaatgcagggctgttatcggactttgtcactcttccgatatagaagtaaattctttgtgggcttggtctggtgtttattattggttatggagctgattgtgtgggcagccagtgcagaaacacaaaatttaaattctgggtggactgacacagcacatggatctgggatcataccaatgaaaactgacctggaattagacttctccctaccatcctctgcaagttacacatataggaggcagttacaaaatccagcaaatgaacaagaaaaaataccatttcatttgcagataagtaaacaagtgattcatgcagaaattcaacatttaggccattggatggatgctacatttaatctaaagacagcattccattgctatggatcttgtgaaaagtatgcttacccttggcagacagcaggttgtttcattgaaaaggactatgagtatgagactggttggggttgcaatccacctgattgccctggggttggtacaggatgtactgcatgtggtgtttatttagataagttaaaatcagttgggaaagtatttaagattgtatcccttaaatatactagaaaggtatgcatccaattaggcactgaacagacctgtaaaactgttgatagtaatgattgtctaatcactacatctgttaaggtgtgcatgattgggactatttcaaaatttcaaccctctgatactttattaattctaggtcctctgcaacaaggtggcttaatctttaaacaatggtgcacaacaacatgtcagtttggggatcctggagatattatgagcacacctacaggaatgaaatgtccagaattaaatggttcattcaggaaaaaatgtgcatttgcaacgacacctgtatgccaatttgatgggaatacaatttcaggatataaacggatgattgcaacaaaagattctttccaatcttttaatgtgacagaacctcacatttctgccagtgcattggaatggatagatcctgatagctcactacgagaccatatcaatgtagttgtaggtcgtgatctatctttccaggatctcagtgaaacaccttgtcaggtggatttaatgacttcaactatagatggggcatggggttcaggagttggattcaatcttgtctgtactgttagcttaacagagtgttcagcatttttaacttccatcaaagcttgtgattcagctatgtgttatggatcaactactgctaatttggtgaaaggtcagaatacagttcatatggttggtaagggaggtcactctggttcaaaattcatgtgttgtcatgacactaaatgttcaagcacgggcttagttgcagctgcaccacatctagatcgtgttacaggctataatcaagcagatagtgataagatatttgatgatggtgcacctgaatgtggtatgtcatgctggtttaaaaaatcaggagaatggatactcggagtgctcaacggaaattggatggttgttgctgtactaattgccctattaatattatccattcttatgttcacattgtgctgtccacgtaggcctagctacaggaaagagcataagccatga

SEQ ID NO: 3401 - RNA, 3447 nt, synthetic construct
  misc_feature 1..3447: note = derived and/or modified CDS sequence (wt) from PUUV(CRF308/Omsk)__AF442617.1__GP
  source 1..3447: mol_type = other RNA
atgggaaaacttagtccagtttgtttgtatctacttctccagtgtctactactaggagatagaggggatgccaggaacctgaatgagcttaaaatggagtgcccacatactatcggattaggtcaaggcctggttgttggttcagtggaactaccaccagttcccatacagcaggttgagtctttaaagctggaaagttcttgtaattttgatttacataccagtacagcaggacaacagtcatttacaaaatggacatgggagataaagaatgatttggctgaaaacacgcaagcatcatcaacaagtttccagacaaaaagcagtgaggtaaatttaagaggattatgcctgataccaacattagtggttgaaacagctgcaaggactcggaagacaatagcctgctacgatctaacatgcaatcagacagtatgccagcccactgtctacttaatgggaccaatccagacttgtataacaacaaaaagctgtctcttgggtttaggtgatcaaaggattcaagtgaattatgagaagacatattgtgtgtcagggcaacttgttgaaggtgtctgttttaatcctatccatacaatggccctttctcaaccaagtcatacatatgatgtaatgacattgatggtgcgttgtttcttaattataaaaaaggtaacatcaggtgatagtatgaagattgaaaaaaactttgaaactcttgtccaaaaaacaggctgtacaggtaataactttcagggttattatatctgtcttataggaagtagctctgagccattgtatgtcccaacattggatgattaccggtcagctgaggtattatcaaggatggcctttgcccctcatggagaagatcatgatattgagaaaaatgctgtaagtacaatgaggattgctggtaaagtggcaggtagggcaccttcaactgaggcctctgatacagtgcaaggtattgctttttcaggtagtcctctttatacatctacaggggttttgacagccaaagatgaccctgtatatatttgggcaccaggaattatcatggagggtaaccattctagttgtgataaaaagacattgccattaacatggacaggctttatttcattaccaggagaaatagaaaaaacaacacaatgtacagtcttttgtaccttggctggaccaggggctgattgtgaggcttattctgagacaggtatttttaatataagttcacctacatgtttaattaatcgtgtgcaaaggttccgtggtgcggagcaacagataaagtttgtctgtcaaagagttgacatggatattattgtatattgtaacggcataaagaaagtaatactaacaaaaacattggttataggacaatgcatttatacattcactagtattttttcattaatcccaggaattgctcactctttagctgttgaattgtgtgtaccgggtcttcatggttggactactatgttgctcttattaactttttgttttggttgggtattaataccatttatcaccatgatactactgaaaatactaattgcatttgcatatctttgttccaagtacaacacagattctaagtttagaattctggttgagaaagtcaagaaagaataccagaaaacaatgggttcaatggtatgtgaggtttgtcaatatgagtgtgaaactgccaaggaactagagtcacatcggaaaagctgttcaattggatcatgcccatattgcctgaatccatctgaggctacaacatctgcccttcaagctcattttaaagtatgtaaactaacatcaaggtttcaggaaaacttaaggaaatcattaacagtctatgaaccaatgcagggctgttatcggactttgtcactcttccgatatagaagtaaattctttgtgggcttggtctggtgtttattattggttatggagctaattgtgtgggcagccagtgcagaaacacaaaatttaaattctggatggactgacacagcacatggatctgggatcataccaatgaaaactgacctggaattagacttctccctaccatcctctgcaagttacacatataggaggcagttacaaaatccagcaaatgaacaagaaaaaataccatttcatttgcagataagtaaacaagtgattcatgcagaaattcaacatttaggccattggatggatgctacatttaatctaaagacagcattccattgctatggatcttgtgaaaagtatgcttacccttggcagacagcaggttgtttcattgaaaaggactatgagtatgagactggttggggttgcaatccacctgattgccctggggttggtacaggatgtactgcatgtggtgtttatttagataagttaaaatcagttgggaaagtatttaagattgtatcccttaaatatactagaaaggtatgcatccaattaggcactgaacagacctgtaaaactgttgatagtaatgattgtctaatcactacatctgttaaggtgtgcatgattgggactatttcaaaatttcaaccctctgatactttattatttctaggtcctctgcaacaaggtggcttaatctttaaacaatggtgcacaacaacatgtcagtttggggatcctggagatattatgagcacacctacaggaatgaaatgtccagaattaaatggttcattcaggaaaaaatgtgcatttgcaacgacacctgtatgccaatttgatgggaatacaatttcaggatataaacggatgattgcaacaaaagattctttccaatcttttaatgtgacagaaccacacatttctgccagtgcattggaatggatagatcctgatagctcactacgagaccatatcaatgtagttgtaggtcgtgatctatctttccaggatctcagtgaaacaccttgtcaggtggatttaatgacttcaactatagatggggcatggggttcaggagttggattcaatcttgtctgtactgttagcttaacagagtgttcagcatttttaacttccatcaaagcttgtgattcagctatgtgttatggatcaactactgctaatttggtgagaggtcagaatacagttcatattgttggtaagggaggtcactctggttcaaaattcatgtgttgtcatgacactaaatgttcaagcacaggcttagttgcagctgcaccacatctagatcgtgttacaggctataatcaagcagatagtgataagatatttgatgatggtgcacctgaatgtggtatgtcatgctggtttaaaaaatcaggagaatggatactcggagtgctcaacggaaattggatggttgttgctgtactaattgccctattaatattatccattcttatgttcacattgtgctgtccacgtaggcctagctacaggaaagagcataagccatga

SEQ ID NO: 3402 - RNA, 3447 nt, synthetic construct
  misc_feature 1..3447: note = derived and/or modified CDS sequence (wt) from PUUV(Mu/07/1219)__KJ994777.1__GP
  source 1..3447: mol_type = other RNA
atggaaaaaattattccagtttgtctgtatctgcccttcttgtgtctgctactatggagtagaggagataccagaaatctgaatgaacttaaaatggaatgcccacatacaattggcttaggtcaaggtcttgttattggatcaattgagttgccaccagtcccactgatacaagtagagtctctaaaactagaaagttcatgcaattttgatctgcatactagcacatcatcacagcaagcgtttacaaaatggacatgggaggtaaagagtgatctggcagagaatacacaggcatcgtcaacaagttttcaaacaaaaagtagtgaggtaaatttaagaggtttatgcttagttccccctttggtgattgaaacagctgcaagaacaagaaaaacaatagcatgttttgatttatcatgtaatcaaacaacatgtcaacctactgtttttttaatgggtccgatacaaacatgcataacaacaaaaagttgtcttttgggtctaggtgatcaaaggattcaggttaattatgaaaaaacatattgtgtttcaggtcaacttattgaaggtatttgtttcaatccagtacacacgatggctctatcccaacctagtcacacatatgatatagtgactgtgatggtgcgctgctttctaattgtcaagaaggtgacaacaggtgatagcatgaaaattgaaaaaagctttgagactcttgttcaaaagactggttgcacagataatggtttccaagggtattatgtttgtctaataggaagcagttcagaaccattatatataccaacattggatgattatagatcggctgaggtcctctctagaatggcttttgcaccacatggagaagatcatgatattgagaagaatgccataagtgcaatgagaattgtgggcaaagtaacaggtaaagcaccatcaaccgaatcatctgacacagtacagggtatagccttttcaggtaatcccctttatacatcaactggggttttaacagcaaaggatgacccagtgtacgtatgggcacctggaatcatgatggaaggaaaccattctgtttgtgaaaagaaaacattgccccttacatggactggtttcataccactgccaggagaaattgagaagacaacacaatgtacagtattctgcacattagcagggccaggcgcagattgtgaggcatattctgaaacaggaatatttaatataagctccccaacttgcttgattaaccgtgtccagagatttcgtggtgctgagcaacaaattaaatttatttgtcaaagggttgacatggatattactgtatactgtaatggtctaaaaaaagtaatcctcactaaaactttagttattgggcaatgtatatatacatttaccagcatattttctttaattcctggagttgcccattcacttgctgtagaactatgtgtgccgggtcttcatggttgggctacaatgctactcttattaacattttgtttcgggtggatcttgataccattttttgccatgatattgctaaaagtattaattgcacttgcttatttatgttcaaagtataatactgattcaaagtttaaagtcctgatagaaaaagttaagaaagaataccaaaaaactatgggctccatggtatgtgaagtctgtcagtatgagtgtgaaactgcaaaggaacttgagtcacatagaaagagttgtccaatgggttcttgtccatattgtctcaaccctgctgaagcaacaacatcagctctgcaagcccattttaaagtatgtaaacttacatcaaggtttcaggataatttaagaaagtcattgggagcatatgaaccaaaacagggttgctacaggacattgtctctattccgatacagaagcagattttttgtagggtttatttggtgtctgctgttagttttggagttgattgtatgggctgctagtgctgaaactcagaacctcaattctggatggacagacacagcacatggatctggagtaataccaatgcggactgaccttgaattagatttttctctcccatcttctgcaagttatacatatagaaggcagctacagaatccagcaaatgaacaagaaaaaattccatttcacttgcagataagtaaacaagtgattcatgcagagattcaacatcttggtcactggatggatggcacattcaacttaaaaactgcatttcattgttatggatcttgtgaaaaatatgcatacccttggcaaacagcaggttgttttgtagagaaagactatgagtatgaaagtggttggggatgtaacccagctgattgcccaggggtagggaccggatgtacagcatgtggtgtatacctggataagttgaaatcagtaggtaaagcattcaaaattgtctctttgagatatactaggaaggcatgtatccagctaggtactgagcaaacttgtaagaatgttgacagtaatgattgtttggtgactacatcagtaaaagtatgtttaatagggactgtgtcaaaatttcaaccatcagatactctattatttctaggtccacttgaacaaggcggactaatttttaagcaatggtgtactacaacatgtcaatttggtgatccaggggatataatgagtactcctgttggaatgaaatgtccagaattaagtggttcatttagaaagaaatgtgcatttgcaacaacacctgtttgtcaatttgatgggaacacaatttctgggtataaaagaatgattgcaacaaaagattcattccaatcatttaatgtaacagaacctcatatctctgcaagttcacttgagtggattgatcctgatagctccctgagagaccacattaatgttattgtaggacgtgatctctcttttcaagatttgagtgagacaccttgtcaagtagatctaacaacaacatcaattgatggggcatggggctcaggagtaggttttaatctaatctgctctgtaagtctaacagagtgttcaacatttttgacttcaattaaagcatgtgactcagcaatgtgttatggttctacaacagctaatcttgtaagaggacagaatacagttcatatcgttggaaagggaggacattcagggtctaaattcatgtgttgccatgatacaaagtgctcaagtactggtttagttgcagcagcaccccatctagatcgtgtgacagggtataatcaggcagacagtgataaaatctttgatgatggtgcccctgaatgtggtatatcttgctggtttacaaagtcaggagaatggattcttggagttctgaatggaaactggatggtagtggctgtattagtggcattattcatattatccatctttctcttcacattatgctgtccacgtaggcctagttatgcaaaggaacataagccttaa

SEQ ID NO: 3403 - RNA, 3447 nt, synthetic construct
  misc_feature 1..3447: note = derived and/or modified CDS sequence (wt) from PUUV(Puu/Kazan)__Z84205.1__GP
  source 1..3447: mol_type = other RNA
atgggaaaacttagtccagtttgtctgtatctgcttctccagggtctattactattcaatacagggactgccagaaacctgaatgagcttaaaatggaatgtccacatactattgggttgggtcaaggccttgttgtaggatcagtggaactgccacctgtcccaatacagcaggtggaaacattgaagctggaaagttcttgtaattttgatttgcatactagtacagcaggacaacaggcatttacaaagtggacatgggaaataaaaggtgatcttgcagaaaatacacaggcatcatcaacaagttttcaaacaaaaagtagtgaagtaaatttgaggggactatgtctaattccaactctagttattgagacagcagcaagaatgcggaaaacaatagcatgttatgatctatcatgtaatcaaacagtatgtcagcctactgtgtatcttatgggacccatccaaacttgcataacaactaagagttgtcttttgggcctaggtgatcaaagaattcaagtgaattatgaaaagacatactgtgtttcagggcagttggttgagggtgtctgtttcaatccaatacatacaatggctctttctcaacccagtcatacttatgatatagttactatgatggttcgttgttttctagttataaaaaaggtgacatctggtgatagcatgaagattgaaaagaactttgagactcttgtccagaagaatggttgtacagccaatagttttcaaggttattacatctgtcttatagggagtagctcagagccactgtatgtcccaacattggatgactatcgttctgctgaagtcctttcaagaatggcatttgcacctcatggggaagatcatgatgttgaaaaaaatgcaataagtgccctacgtattgctgggaaagtgacagggaaagcaccatccaccgagtcttctgacacagtacaaggtgttgcattttcaggtagtcctctttatacatctaccggggttttaacagcaaaggacgatcctgtgtacatctgggccccgggtattatcatggaagggaaccattctgtctgtgagaaaaagaccttacctctcacatggactgggttcatctcattgcctggagaaattgagaagacaacacaatgcacagtcttctgcaccctggctggaccaggtgcagactgtgaagcttattctgaaacaggcatttttaatataagctcaccaacttgcctaatcaatcgtgtgcaaaggttccgtggtgcagagcaacaaataaagtttgtttgtcagagagttgatatggatatcactgtgtattgtaatggagtcaagaaagtcattctaaccaaaaccttagttattggacagtgtatttatacatttactagtatattctctttaatcccaggggttgcacactctcttgctgtagagttatgtgtaccaggtcttcatggctgggcaactatgttattgttactaacattttgctttggatgggttctaataccaaccattacaatgatattgctgaaaattttaattgcatttgcatatctttgttctaagtataatacagattcaaaattcaggattttgattgaaaaagtaaaaaaggaatatcagaaaacaatgggctcgatggtctgtgaggtgtgtcaatatgaatgtgagactgcaaaggaactagaatcacataggaaaagctgttcaattggctcatgtccttattgtcttaacccgtctgaggcaacaacatctgccctccaggcccattttaaagtctgtaaacttacatcacggattcaggagaatctgagaaaatcattaacagtatatgagcccatgcagggttgttatcgcaccttatctctcttcagatatcggagtcggttctttgttggtttagtctggtgtgtgctattagttttagagttgattgtatgggctgctagtgctgagacacagaatttgaatgcaggctggactgatacagcacatggatctgggataatacctatgaaaactgaccttgaattggacttctctcttccttcatctgcaagctatacatataggagacagctacagaatccagctaatgaacaagaaaacataccatttcatctacagataagtaaacaggtaatccatgcagagatacagcacttaggtcactggatggatgctacatttaatctaaaaactgcatttcattgttatggttcatgtgaaaaatatgcttatccttggcaaactgctggttgttttgtagaaaaggattatgagtatgagactggttggggctgtaacccacctgattgccctggagtagggacaggctgtactgcctgtggggcctatcttgataaattaaaatcagttgggaaagtcttcaaaattgtgtccttgaggtataccaggaaagtgtgtattcaattaggcactgaacaaacctgtaagactgttgatagtaatgactgtttaataactacttcagtcaaagtgtgtttaatagggacaatttcaaaatttcaaccctctgataccctcctattcctaggtcctctccaacagggtggtttaatatttaagcaatggtgcactacaacatgccaatttggtgaccctggagatataatgagcacacccacagggatgaaatgcccagatttaaatgggtcctttagaaaaaaatgtgcatttgcaacaacacctgtgtgccagtttgatggaaatacaatttcaggatacaaaaggatgattgctacaaaggattcatttcaatctttcaatgtcacagaaccccacatatctgcaagtgcattagaatggattgatcctgacagttcacttagggatcatataaatgtaattgtaagccgtgatttatcttttcaagatttaagtgaaacaccatgccaaatagatctttcaacagcatccatagatggggcatggggttcaggggttggttttaacctggtctgtactgttagcttaacagagtgttctgcatttcttacttcaattaaggcatgtgatgccgcaatgtgttatggatctactacagctaatttagttaggggacaaaataccattcacattgttgggaagggtgggcattctggctcaaaatttatgtgttgtcatgacacaaaatgctcgaccactggccttgttgcagctgcaccacatttagatcgtgtgacgggatacaatcaagcagatagtgataaaatctttgatgatggtgcaccagagtgtggtatgtcttgctggtttaaaaagtctggagaatggattcttggggtcctcaacggaaattggatggtagtagctgtattgatagcattattaattttgtccattctcttgttcacattatgctgcccacgcagacctagttacagaaaagagcataaaccttag

SEQ ID NO: 3404 - RNA, 3447 nt, synthetic construct
  misc_feature 1..3447: note = derived and/or modified CDS sequence (wt) from PUUV(PUUV/Ardennes/Mg156/2011)__KT247603.1__GP
  source 1..3447: mol_type = other RNA
atgggtaaaattattccagtttgtctgtacctgctcttcttgtgtctgctactatgggatagaggagataccagaaacctgaatgaacttaaaatggaatgtccgcacacaattggtttgggtcagggccttgttattggatcagttgaattaccgcctgttccgttgacacaggtagagtctttaaaactggaaagttcatgcaattttgatctacataccagtacatcatcacaacagtcattcacaaaatggacatgggagatgaaggttgacctagcagaaaatacacaagcatcatctacaagctttcaaacaaaaagtagtgagataaacttacgaggtttatgcttggttcctcctttggtgattgagactgctgcaaggactcggaaaacaatagcatgttttgacttatcctgtaatcagacagcctgccagcctaccgtctttttaataggcccaatacaaacatgcataacaacaaaaagttgccttttgggtttaggtgatcagagaatccaagtcaattatgaaaaaacatattgtgtttcaggtcaacttgttgagggtatctgtttcaacccagtacataccatggccttgtctcaacctagccacacatatgatatagtgactgtgatggtgcgttgttttttaattgtgaaaaaggtctcaacaggtgatagtatgaagcttgaaaagagctttgagactcttgttcagaaaactggctgtacaggcaatggtttccaaggttattatgtctgtttgataggaagtagttctgaaccactatatattccaacattggatgattataggtcggcagaggtcctttcaaggatggcatttgcacctcatggggaagatcatgatatagaaaaaaatgctataagtgcaatgaggattgtcgggaaagtgacaggcaaagcaccatcaactgagtcatctgatacagtacagggcattgccttttcaggtaaccccctttatacatcaactggggttttaacagcaaaggatgaccctatatacatttgggcacctggaattataatggagggaaaccactctgtttgtgacaaaaaaacactacctctcacatggactggttttataccactaccaggggaaattgagaagacaacacagtgtacagtattctgtacattggctggacctggtgcagattgtgaggcatattctgaaacagggatatttaacataagttctccaacctgtttgattaaccgtgtgcagagattccgtggtgctgagcagcaaatcaaattcatttgccagagggttgatatggacataacagtgtactgtaatgggttgaagaaagtgattcttaccaaaactctagttattggacaatgtatttatacttttacaagcattttttcattaatccctggggttgctcattcactagctgtagaattatgtgtaccaggtcttcatggttgggctacaatgttacttttattaacattttgctttgggtggatcttaataccatttttttccatgatattgttgaaaatcttaattgcatttgcttacttatgctctaaatataatacagattcaaagtttaaaatattaatagaaaaagtgaaaaaagaatatcaaaagactatgggctccatggtatgtgaagtttgtcagtatgagtgtgagactgcaaaagaactagagtcacataggaaaagttgcccaatgggttcatgtccatattgtctaaatcctgctgaagcaacaacatctgctctacaggcccattttaaagtatgtaaactcacatcgagatttcaggacaatttaaggaagtcactgggggcatatgagccaaaacagggttgttacagaacattgtctcttttccgttatagaagcaggttttttgtgggattcatttggtgtttcttgttagtcttagaattgattgtgtgggctgctagtgctgaaactcaaaatcttaattccggatggacagacacagcacatggatctggaataatacccatgaggactgaccttgaacttgatttttctctcccatcttctgcaagttatacatataggagacagttacagaatccagcaaatgagcaagagaaaataccatttcatttacagataagtaaacaggtaatccacgcagaaattcaacatttaggccattggatggatggtacatttaacctgaaaactgcatttcactgttatggttcatgtgaaaagtatgcatacccttggcagacagcaggctgttttgtagaaaaagattatgagtatgaaagtggatggggatgtaatccaccagattgtccaggggtgggaactgggtgtacagcatgtggtgtgtatttagacaagctaaaatcagtgggtaaagcatttaaaattgtgtctttgagatacacaaggaaagcatgtattcagcttgggactgaacaaacctgtaaaagtgtagatagtaatgattgcttggtgactacatcagtcaaagtgtgcttaattggaactgtgtcaaaatttcaaccatcagatactctattattcttaggtccacttgaacaaggtgggttgatttttaagcagtggtgcactacaacatgtcaatttggtgacccgggggatataatgagtactccagtcggaatgaagtgccctgaattaagcggttcattcagaaaaaaatgcgcatttgcaacaacacctgtttgccaatttgatggaaatactctttctggatataaacgaatgattgcaacaaaagattcatttcaatcattcaatgtcacagaaccccatatttctgcaagctcacttgaatggattgaccctgacagttccctgagagaccatattaatgttattgtaggacgtgatctctcttttcaagatctaagtgaaacaccctgtcaggtagacttagcaacatcatcaattgatggggcatggggttcaggagtaggttttaatttagtttgttcagttagcctgacagaatgttctacatttttaacttcaataaaggcatgtgactcagcaatgtgttatggctcaacaacagccaatcttttaagagggcaaaatacagttcatattgtagggaaaggagggcattctgggtctaaattcatgtgttgtcatgatacaaagtgctcaagcactggcttggttgcagctgcaccacatttggatcgtgtgacaggatataatcaagcagatagtgataagatttttgatgatggtgcccctgaatgcggtatatcttgttggtttacaaaatcaggagaatggattcttggagttttgaacggaaattggatggtagtggctgtattagtagcattattcatattatctattttcctcttcacattatgttgcccacggaggcctagctatgcaaaagaacataagccttaa

SEQ ID NO: 3405 - RNA, 3447 nt, synthetic construct
  misc_feature 1..3447: note = derived and/or modified CDS sequence (wt) from PUUV(PUUV/Ardennes/Mg75/2011)__KT247602.1__GP
  source 1..3447: mol_type = other RNA
atgggaaaaattattccagtttgtctgtacctgctcttcttgtgtctgctactatgggatagaggagataccagaaacctgaatgaacttaaaatggaatgtccgcacacaattggtttgggtcagggccttgttattggatcagttgaattaccgcctgttccgttgacacaggtagagtctttaaaactggaaagttcatgcaattttgatctacataccagtacatcatcacaacagtcattcacaaaatggacatgggagatgaaggttgacctagcagaaaatacacaagcatcatctacaagctttcaaacaaaaagtagtgagataaacttacgaggtttatgcttggttcctcctttggtgattgagactgctgcaaggactcggaaaacaatagcatgttttgacttatcctgtaatcagacagcctgccagcctaccgtctttttaataggcccaatacaaacatgcataacaacaaaaagttgccttttgggtttaggtgatcagaggattcaagtcaattatgaaaaaacatattgtgtttcaggtcaacttgttgagggtatctgtttcaacccagtacataccatggccttgtctcaacctagccacacatatgatatagtgactgtgatggtgcgttgttttttaattgtgaaaaaggtctcaacaggtgatagtatgaagcttgaaaagagctttgagactcttgttcagaaaactggctgtacaggcaatggtttccaaggttattatgtctgtttgataggaagtagttctgaaccactatatattccaacattggatgattataggtcagcagaggttctttcaaggatggcatttgcacctcatggggaagatcatgatattgaaaaaaatgcaataagtgcaatgaggattgtcggaaaagtgacaggcaaagcaccatcaactgagtcatctgatacagtacagggcattgccttttcaggtaaccccctttatacatcaactggggttttaacagcaaaggatgaccctatatacatttgggcacctggaattataatggagggaaaccactctgtttgtgacaaaaaaacactacctctcacatggactggttttataccactaccaggggaaattgagaagacaacacagtgtacagtattctgtacattggctggacctggtgcagattgtgaggcatattctgaaacagggatatttaacataagttctccaacctgtttgattaaccgtgtgcagagattccgtggtgctgagcagcaaatcaaattcatttgccagagggttgatatggacataacagtgtactgtaatgggttgaagaaagtgattcttaccaaaactctagttattggacaatgtatttatacttttacaagcattttttcattaatccctggggttgctcattccctagctgtagaattatgtgtgccaggtcttcatggttgggctacaatgttacttttattaacattttgctttgggtggatcttaataccatttttttccatgatattgttgaaaatcttaattgcatttgcttacttatgctctaaatataatacagattcaaagtttaaaatattaatagaaaaagtgaaaaaagaatatcaaaagactatgggctccatggtatgtgaagtttgtcagtatgagtgtgagactgcaaaagaactagagtcacataggaaaagttgcccaatgggttcatgtccatattgtctaaatcctgctgaagcaacaacatctgctctacaggcccattttaaagtatgtaaactcacatcgagatttcaggacaatttaaggaagtcactgggggcatatgagccaaaacagggttgttacagaacattgtctcttttccgttatagaagcaggttttttgtgggattcatttggtgtttcttgttagtcttagaattgattgtgtgggctgctagtgctgaaactcaaaatcttaattccggatggacagacacagcacatggatctggaataatacccatgaggactgaccttgaacttgatttttctctcccatcttctgcaagttatacatataggagacagttacagaatccagcaaatgagcaagagaaaataccatttcatttacagataagtaaacaggtaatccacgcagaaattcaacatttaggccattggatggatggtacatttaacctgaaaactgcatttcactgttatggttcatgtgaaaagtatgcatacccttggcagacagcaggctgttttgtagaaaaagattatgagtatgaaagtggatggggatgtaatccaccagattgtccaggggtgggaactgggtgtacagcatgtggtgtgtatttagacaagctaaaatcagtgggaaaagcatttaaaattgtatctttgagatacacaaggaaagcatgtattcagcttgggactgaacaaacctgtaaaagtgtagatagtaatgattgcttggtgactacatcagtcaaagtgtgcttaattggaactgtgtcaaaatttcaaccatcagatactcttttatttttaggtccacttgaacaaggtgggttgatttttaagcagtggtgcactacaacatgtcattttggtgacccgggggatataatgagtacaccagtcagcatgaagtgccctgaattaagcggttcatttagaaaaaaatgtgcctttgcaacaacacctgtttgtcaatttgacggaaatactctttccggatataaacgaatgattgcaacaaaagattcatttcaatcattcaatgtcacagaaccccatatttctgcaagctcacttgaatggattgaccctgacagttccctgagagaccatattaatgttattgtaggacgtgatctctcttttcaagatctaagtgaaacaccctgtcaggtagacttagcaacatcatcaattgatggggcatggggttcaggagtaggttttaatttagtttgttcagttagcctgacagagtgttctacatttttaacttcaattaaggcatgtgactcagcaatgtgttatggctctacaacagccaatcttttaagagggcaaaatacagttcatattgtagggaaaggagggcattctgggtctaaattcatgtgttgtcatgatacaaagtgctcaagcactggcttggttgcagctgcaccacatttggatcgtgtgacaggatataatcaagcagatagtgataagatttttgatgatggtgcccctgaatgcggtatatcttgttggtttacaaaatcaggagaatggattcttggagttttgaacggaaattggatggtagtggctgtattagtagcattattcatattatctattttcctcttcacattatgttgcccacggaggcctagctatgcaaaagaacataagccttaa

SEQ ID NO: 3406 - RNA, 3447 nt, synthetic construct
  misc_feature 1..3447: note = derived and/or modified CDS sequence (wt) from PUUV(PUUV/Jura/Mg2/2010)__KT247598.1__GP
  source 1..3447: mol_type = other RNA
atgggaaaaattattccagtttgtctgtatctgctcttcctgtgtctgctactatggaatagaggggataccagaaacctgaatgaacttaaaatggaatgtccacacacaattggtctgggtcagggccttgttattggatcagttgagttaccaccagttccgttaacacaagtggagtctctaaaactggaaagttcatgtaactttgacctgcatactagcacatcatcacaacaatcatttacaaaatggacatgggaaatgaagagtgatttggcagagaacacgcaggcatcatcaacaagttttcaaacaaaaagtagtgaaataaacttacgaggtttatgcttggttcctcctttggtaattgaaactgcagcaaggactcgaaagacaatagcatgttttgatttatcatgtaatcaaacagcatgtcaacctactgtcttcctgataggtccaatacaaacatgtctaacaacaaagagttgtcttttaggtctaggtgatcagagaattcaagttaattatgagaaaacatattgtgtttcaggtcaacttgttgaaggtgtgtgtttcaatccaatacatactatggctttatctcagcctagccatacatatgacatagtgactgtgatggtgcgttgctttttaattgtaaaaaaggtttcaacaggtgacagcatgaaaattgagaagagctttgagacccttgtccaaaagactggttgtacaggtaatggttttcaaggttattatgtttgtcttataggaagcagttcagaaccattatatatcccaacattggatgattataggtcggctgaggtcctttcaaggatggcatttgcaccacatggtgaagaccatgatattgaaaagaatgccataagtgcaatgaggattgtgggaaaagtgacaggcaaagcaccttcaactgagtcatctgatacagtacaaggtatagccttttcaggtaatcccctttatacatcaactggggtattaacagcaaaagatgaccctatatatatatgggcaccaggaatcataatggaaggaaaccactctgtctgtgaaaagaaaacactgcctcttacatggactggttttataccattgccaggagaaattgagaagacaacacaatgcacagtattttgtactttagctggaccaggtgcagattgtgaggcatattctgaaacagggatattcaacataagttctccaacttgcttaattaatcgtgtgcaaagatttcgtggtgctgaacaacagataaaatttatttgccaaagggttgatatggatattactgtatactgtaatggtctgaagaaagtgattctgactaaaactttagttattggacaatgtatttacacttttactagtattttctctttgattcctggagttgcccattcacttgctgtagaattatgtgtaccagggctccatggctgggctacaatgctactcttattaactttttgcttcggatggatcttgataccatttactgctatgttattattaaaaatattgattgcatttgcttacttgtgctcaaagtataatacagattcaaagtttaaaatcttaattgagaaagtcaaaaaagaatatcaaaaaacaatgggctctatggtatgtgaagtctgtcaatatgagtgtgagactgcaaaggaattagagtcacataggaaaagttgtccaatgggttcatgcccatattgtctgaatcctgctgaagccacaacatctgctttacaagcccattttaaagtgtgtaaactaacgtcaagatttcaggataacttaaggaagtcgttaggcgcttatgaaccaaaacagggctgttacaggacattgtccctctttcgttatagaagcaggttttttgtaggattagtttggtgttttttgttagtcttagaattaattatttgggctgctagtgctgaaactcaaaacctcaattctgggtggacagatacagcacatgggtctggagtgataccaatgagaacagaccttgaattggatttttctcttccatcttctgcaagttatacatatagaagacagttgcagaacccagcaaatgaacaagagaaaattccatttcacttacaaataagtaaacaggtgatccatgctgagattcaacatctaggtcactggatggatggcacattcaacttgaaaactgcatttcactgttatggctcttgtgaaaagtatgcatatccttggcaaacagcaggctgttttgtagagaaagactatgagtatgaaagtggttggggatgtaacccacctgattgcccgggagttggaactggatgcacagcatgtggtgtgtatttagataagttgaaatcagtgggtaaagcattcaggattgtgtccttaaaatatacaaggaaagcatgtattcagctaggtactgaacaaacttgtaaaagtgttgacagtaatgattgtcttgtaactacatctgtcaaagtatgtttgattggaactgtgtcaaaatttcaaccatcagataccctgttatttctaggtccacttgagcagggtgggttaatttttaaacagtggtgtacaacaacatgtcaatttggagatccacgggatataatgagcactccggttggtatgaggtgcccagaattaagtggttcatttagaaaaaaatgtgcatttgcaacaacacctgtttgtcaatttgatggaaatactatctctgggtataaaagaatgattgcaacaaaggattcattccagtcattcaatgtcacagaaccacatatctctgcaagttcacttgagtggattgaccctgatagttctcttagagaccatattaatgtgattgtgggacgtgacctctcttttcaggatctaagtgagacaccttgtcaagtagatttaacaacaacatcaattgatggggcatggggttctggagttggcttcaacctaatttgttctgtaagtctaacagagtgttcaacatttttaacttcaattaaagcatgtgactcagcaatgtgttatggctcaacaactgctaatcttatgagagggcaaaatacaatccatatcgttggaaaaggaggacattctgggtctaaattcatgtgctgccatgatacaaagtgttcaagtactggtctggtagcagcagcaccacatttagatcgtgtaacaggatataaccaagcagacagtgataaaatctttgatgatggtgcccctgaatgtggtatatcttgttggtttacaaagtcaggggaatggattctgggtgtcttgaatggaaattggatggtagtggctgtgttagtggtattattcatattatccatttttctctttacattatgttgcccacgtagacctagttatgcaaaagaacataaaccttag

SEQ ID NO: 3407 - RNA, 3447 nt, synthetic construct
  misc_feature 1..3447: note = derived and/or modified CDS sequence (wt) from PUUV(PUUV/Jura/Mg214/2010)__KT247599.1__GP
  source 1..3447: mol_type = other RNA
atgggaaaaattattccagtttgtctgtatctgctcttcctgtgtctgctactatggaatagaggggataccagaaacctgaatgaacttaaaatggaatgtccacacacaattggtctgggtcagggccttgttattggatcagttgagttaccaccagttccgttaacacaagtggagtctctaaaactggaaagttcatgtaactttgacctgcatactagcacatcatcacaacaatcatttacaaaatggacatgggaaatgaagagtgatttggcagagaacacgcaggcatcatcaacaagttttcaaacaaaaagtagtgaaataaacttacgaggtttatgcttggttcctcctttggtaattgaaactgcagcaagaactcgaaagacaatagcatgttttgatttatcatgtaatcaaacagcatgtcaacctactgtcttcttgataggcccaatacaaacatgtctaacaacaaagagttgtcttttaggtctaggtgatcagagaattcaagttaattatgagaaaacatattgtgtttcaggtcaacttgttgaaggtgtgtgtttcaatccaatacatactatggctttatctcagcctagccatacatatgacatagtgactgtgatggtgcgttgctttttaattgtaaaaaaggtttcaacaggtgacagcatgaaaattgagaagagctttgagacccttgtccaaaagactggttgtacaggtaatggttttcaaggttattatgtttgtcttataggaagcagttcagaaccattatatatcccaacattggatgattataggtcggctgaggtcctttcaaggatggcattggccccacatggtgaagaccatgatattgaaaagaatgccataagtgcaatgaggattgtgggaaaagtgacaggcaaagcaccttcaactgagtcatctgatacagtacaaggtatagccttttcaggtaatcccctttatacatcaactggggtattaacagcaaaagatgaccctatatatatatgggcaccaggaatcataatggaaggaaaccactctgtctgtgaaaagaaaacactgcctcttacatggactggttttataccattgccaggagaaattgagaagacaacacaatgcacagtattttgtactttagctggaccaggtgcagattgtgaggcatattctgaaacagggatattcaacataagttctccaacttgcttaattaatcgtgtgcaaagatttcgtggtgctgaacaacagataaaatttatttgccaaagggttgatatggatatcactgtatactgtaatggtctgaagaaagtgattctgactaaaactttagttattggacaatgtatttacacttttactagtattttctctttgattcctggagttgcccattcacttgctgtagaattatgtgtaccagggctccatggctgggctacaatgctactcttattaactttttgcttcggatggatcttgataccatttactgccatgttattattaaaaatattgattgcatttgcttacttgtgctcaaagtataatacagattcaaagtttaaaatcttaattgagaaagtcaaaaaagaatatcataaatcaatgggctctatggtatgtgaagtctgtcaatatgagtgtgagactgcaaaggaattagagtcacataggaaaagttgtccaatgggttcatgcccatattgtctgaatcctgctgaagcaacaacatctgctttacaagctcattttaaagtgtgtaaactaacgtcaagatttcaggataacttaaggaagtccttaggtgcatatgaaccaaaacagggttgttacaggacattgtcccttttccgttataggagcaggttctttgtaggtttagtttggtgttttttattagtcttagaattgattatttgggctgctagtgctgaaactcaaaacctcaattcagggtggacagatacagcacatggttcaggagttataccaatgagaacagaccttgaattagatttctctctcccatcttctgcaagttatacatatagaagacagttgcagaacccagcaaatgaacaagagaaaattccatttcacttacaaataagtaaacaggtgatccatgctgagattcaacatctaggtcactggatggatggcacattcaacttgaaaactgcatttcactgttatggctcttgtgaaaagtatgcatatccttggcaaacagcaggctgttttgtagagaaagactatgagtatgaaagtggttggggatgtaacccacctgattgcccgggagttggaactggatgcacagcatgtggtgtgtatttagataagttgaaatcagtgggtaaagcattcaggattgtgtccttaaaatatacaaggaaagcatgtattcagctaggtactgaacaaacttgtaaaagtgttgacagtaatgattgtcttgtaactacatctgtcaaagtatgtttgattggaactgtgtcaaaatttcaaccatcagataccctgttatttctaggtccacttgagcagggtgggttaatttttaaacagtggtgtaccacaacatgtcaatttggtgatccaggggatataatgagcactccggttggtatgaggtgcccggaattaagtggttcatttagaaaaaaatgtgcatttgcaacaacacctgtttgtcaatttgatggaaatactatctctgggtataaaagaatgattgcaacaaaggattcattccagtcattcaatgtcacagaaccacatatctctgcaagttcacttgagtggattgaccctgatagttctcttagagaccatattaatgtgattgtgggacgtgacctctcttttcaggatctaagtgagacaccttgtcaagtagatttaacaacaacatcaattgacggggcatggggttctggagttggcttcaacctaatttgttctgtaagtctaacagagtgttcaacatttttaacttcaattaaagcatgtgactcagcaatgtgttatggctcaacaactgctaatcttatgagagggcaaaatacaatccatatcgttggaaaaggaggacattctgggtctaaattcatgtgctgccatgatacaaagtgttcaagtactggtctggtagcagcagcaccacatttagatcgtgtaacaggatataaccaagcagacagtgataaaatctttgatgatggtgcccctgaatgtggtatatcttgttggtttacaaagtcaggggaatggattctgggtgtcttgaatggaaattggatggtagtggctgtcttagtggtattattcatattatccatttttctctttacattatgttgcccacgtagacctagttatgcaaaagaacataaaccttag

SEQ ID NO: 3408 - RNA, 3447 nt, synthetic construct
  misc_feature 1..3447: note = derived and/or modified CDS sequence (wt) from PUUV(PUUV/Orleans/Mg23/2010)__KT247600.1__GP
  source 1..3447: mol_type = other RNA
atgggaaaaattattccagtttgtctgtacttgctcttccggtgtctattactatgggatagaggaaatgccagaaacctgaatgagcttaaaatggaatgtccacacacaattggtttaggtcaaggccttgttattggatcagttgaattaccaccagttccattaacacaaatagaatctctaaaactcgagagctcatgtaacttcgatttgcatactagcacatcatcacagcagtcattcacaaaatggacctgggaaataaaaagtgatttggcagaaaacacacaagcctcatcaacaagttttcaaacaaagagtagtgaggtaaacctgcgtggtctgtgtctagtccctccattagtaatagaaactgctgcaagaactcggaagacaatagcatgttttgatttatcatgtaatcagacagcatgtcaacctactgttttcttgattggcccgatacaaacatgcataacaacaaagagctgcctcttaggtttaggtgatcagaggattcaggttaactatgaaaaaacgtactgtgtttcaggtcaacttattgaaggtatttgctttaacccggttcacactatggccctatctcagcctagccatacatatgacgtggtaactgtgatggtgcgttgttttttaattgtgaaaaaagtatcaacaggggatagcatgaagattgaaaaaagctttgagactcttgtccaaaaaactggttgtacaggtaatggctttcaaggctattatgtctgtttgataggaagtagttcagagccattatatatcccaacattggatgattataggtcagctgaggtgttatcaagaatggcatttgccccacatggcgaggaccatgacattgaaaaaaatgccataagtgcaatgaggattgttggtaaagtaacaggtaaggcaccatcaactgaggcatctgacacagtacagggtatagctttttcaggtaatcctctctatacatcaactggggttttaacagcaaaagatgatcctatatatatatgggcaccagggatcataatggagggaaaccattctgtttgtgaaaagaaaacattgcctcttacatggactggttttataccattacctggagaaattgaaaaaacgacacaatgcacagtattttgtactctggctggccctggtgcagattgtgaagcttattcagaaacaggcatattcaacataagttcccctacgtgtttaataaatcgtgtacagaggtttcgtggtgctgaacaacaaataaaattcatctgtcaaagggttgatatggatatcactgtatattgcaacgggttgaagaaagtaattcttaccaaaactttcattataggacaatgtatatatacattcactagtatcttttccttaataccaggagttgcccactcacttgctgtagaactatgtgtgccaggtctccatggctgggctacaatgttactcctactaacattctgttttgggtgggtcttgataccatttttttctatgatattattaaaaatactaattgcatttgcgtatttatgctcaaaatacaatacagattcaaagtttagaatcttaatagagaaagtaaaaagggagtatcaaaagactatgggctctatggtctgtgaagtctgtcaatatgagtgtgaaactgcaaaagaactggaatcacacaggaagagttgcccgatgggttcatgtccgtactgcctcaatcctgctgaagctaccacgtctgcactacaagcccattttaaagtgtgcaagctcacatcgaggtttcaggacaatttaaggaagtcattaggggcatatgaaccgaagcagggttgttaccgaacattgtcccttttccgttatagaagtaggttttttgtgggtttcatttggtgctttttattagtcttagaattgattatttgggctgctagtgctgaaactcaaaatcttaattcagggtggacagatacagcacatggttcaggagttataccaatgagaactgaccttgaattagatttctctctcccatcttctgccagttatacatacaggagacaattacagaatccagccaatgaacaggaaaagatcccgtttcaccttcagataagtaaacaagttatccatgcagagattcaacatttaggtcactggatggatggcacatttaacttaaaaactgcattccattgttatggctcttgtgagaaatatgcatatccctggcaaacagcaggttgtttcatagaaaaggattatgagtatgaaagtggctggggctgcaatcctcctgactgcccaggtgtggggactggatgtacagcatgtggtgtgtacttagataaactaaaatcagttggtaaggcattcaaaattgtatccttgaggtacacaagaaaggcatgtattcaacttggtaccgagcaaacttgtaaaagtgttgatagtaatgactgcttagtaacaacatcagtcaaagtatgtttaattgggacagtatcaaagtttcagccatcagatactttattatttttaggcccacttgagcaaggtgggttgattttcaagcagtggtgcactacaacatgtcattttggtgatccaggggatataatgagtacaccagcaggaatgaaatgcccagaattgagtggttcatttacaaagaaatgtgcatttgccccaacacctgtgtgccaatttgatggggatactacttccggatataaaaaaatgattgcaacaaaggattcttttcaatccttcaatgtcacagagcctcatatctctgcaagttcactcgaatggattgatcccgatagatcacttagggaccatatcaatgtaatcgtgggacgtgacctctcttttcaggatttaagtgaaacaccttgccaagttgatctaactacaacatctattgatggggcatggggttcaggagtaggtttcaacctgatttgttctgtcagcttgacagagtgttcaacattcttgacttcaattaaagcatgtgattcagcaatgtgttatggttctacaacagctaatctcttaagaggacaaaatacagtccacattgttggcaaaggaggacattctggttctaaattcatgtgctgtcatgatacaaagtgctctagcactggtctggttgctgcagcaccgcatttagaccgtgtaacaggatataaccaagcagacagtgataagatctttgatgatggtgctccagaatgcggtatttcatgctggcttacaaaatcaggagagtggatccttggtgtcctaaatggaaactggatggttgtggctgttttagtggcattgtttatattttctatcttcctcttcacattgtgctgtccacgtaggcccagttatgcaaaagaacataaaccttaa

SEQ ID NO: 3409 - RNA, 3447 nt, synthetic construct
  misc_feature 1..3447: note = derived and/or modified CDS sequence (wt) from PUUV(PUUV/Orleans/Mg29/2010)__KT247601.1__GP
  source 1..3447: mol_type = other RNA
atgggtaaaattattccagtttgtctgtacttgctcttccggtgtctattactatgggatagaggaaatgccagaaacctgaatgagcttaaaatggaatgtccacacacaattggtttaggtcaaggccttgttattggatcagttgaattaccaccagttccattaacacaaatagaatctctaaaactcgagagctcatgtaacttcgatttgcatactagcacatcatcacagcagtcattcacaaaatggacctgggaaataaaaagtgatttggcagaaaacacacaagcctcatcaacaagttttcaaacaaagagtagtgaggtaaacctgcgtggtctgtgtctagtccctccattagtaatagaaactgctgcaagaactcgaaagacaatagcttgctttgatttatcttgtaatcaaacagcatgtcagcctactgtctttttaataggcccaatacaaacatgcataacaacaaaaagttgtcttttaggtttaggtgatcagaggattcaagttaattatgaaaaaacatattgtgtttcaggtcaacttgttgagggtgtgtgtttcaatccaatacataccatggccttatctcagcctagccacacatatgacatagtgactgtgatggtgcgttgctttttaattgtaaaaaaggtttcaacaggtgacagcatgaaaattgagaagagctttgagacccttgtccaaaaaactggttgtacaggtaatggttttcaaggttattatgtttgtttgataggaagcagttccgaaccattatatatcccaacattggatgattataggtcagctgaggttttatcaagaatggcatttgcaccacatggcgaggaccatgacattgaaaaaaatgccataagtgcaatgaggattgttggtaaagtaacaggtaaggcaccatcaactgaggcatctgacacagtacagggtatagctttttcaggtaatcctctctatacatcaactggggttttaacagcaaaagatgatcctatatatatatgggcaccagggatcataatggagggaaaccattctgtttgtgaaaagaaaacattgcctcttacatggactggttttataccattacctggagaaattgaaaaaacgacacaatgcacagtattttgtactctggctggccctggtgcagattgtgaagcttattcagaaacaggcatattcaacataagttcccctacgtgtttaataaatcgtgtacagaggtttcgtggtgctgaacaacaaataaaattcatctgtcaaagggttgatatggatatcactgtatattgcaatgggttgaagaaggtaattcttaccaaaactttcattataggacaatgtatatatacgttcactagtatcttttccttaataccaggagttgcccactcacttgctgtagaactatgtgtgccaggtctccatggctgggctacaatgttactcctactaacattctgttttgggtgggtcttgataccatttttttctatgatattattaaaaatactaattgcatttgcgtatttatgctcaaaatacaatacagattcaaagtttagaatcttaatagagaaagtaaaaagggagtatcaaaagactatgggctctatggtctgtgaagtctgtcaatatgagtgtgaaactgcaaaagaactggaatcacacaggaagagttgcccgatgggttcatgtccgtactgcctcaatcctgctgaagctaccacgtctgcactacaagcccattttaaagtgtgcaagctcacatcgaggtttcaggacaatttaaggaagtcattaggggcatatgaaccgaagcagggttgttaccgaacattgtcccttttccgttatagaagtaggttttttgtgggtttcatttggtgctttttattagtcttagaattgattatttgggctgctagtgctgaaactcaaaatcttaattcagggtggacagatacagcacatggttcaggagttataccaatgagaactgaccttgaattagatttctctctcccatcttctgcaagttatacatacaggagacaattacagaatccagcaaatgaacaggaaaagatcccgtttcaccttcagataagtaaacaagttatccatgcagagattcaacatttaggtcactggatggatggcacatttaacttaaaaactgcattccattgttatggctcttgtgagaaatatgcatatccctggcaaacagcaggttgtttcatagaaaaggattatgagtatgaaagtggctggggctgcaatcctcctgactgcccaggtgtggggactggatgtacagcatgtggtgtgtacttagataaactaaaatcagttggtaaggcattcaaaattgtatccttgaggtacacaagaaaggcatgtattcaacttggtaccgagcaaacttgtaaaagtgttgatagtaatgactgcttagtaacaacatcagtcaaagtatgtttaattgggacagtatcaaagtttcagccatcagatactttattatttttaggcccacttgagcaaggtgggttgattttcaagcagtggtgcactacgacatgtcattttggtgatccaggggatataatgagtactccagcaggaatgaaatgcccagaattgagtggttcatttagaaagaaatgtgcatttgccccaacgcctgtttgccattttgatgggaaaactatttccggatataaaagaatgattgcaactaaagattcattccaatcattcaatgtcacagagcctcatatctctgcaagttcactcgaatggattgatcctgatagttcacttagggaccatatcaatgtaatcgtaggacgtgacctctcttttcaggatttaagtgaaacaccttgtcaagttgatctaactacaacatctattgatggggcgtggggttcaggagtaggtttcaacctgatttgttctgtcagcttgacagagtgttcaacattcttgacttcaattaaagcatgtgattcagcaatgtgttatggttctacaacagctaatctcttaagaggacaaaatacagtccacattgttggcaaaggaggacattctggttctaaattcatgtgctgtcatgatacaaagtgctctagcactggtctggttgctgcagcaccgcatttagaccgtgtaacaggatataaccaagcagacagtgataagatctttgatgatggtgctccagaatgcggtatttcctgctggcttacaaaatcaggagagtggatccttggtgtcctaaatggaaactggatggttgtggctgttttagtggcattgtttatattttctatcttcctcttcacattgtgctgtccacgtaggcccagttatgcaaaagaacataaaccttaa

SEQ ID NO: 3410 - RNA, 3447 nt, synthetic construct
  misc_feature 1..3447: note = derived and/or modified CDS sequence (wt) from PUUV(Vranica)__U14136.1__GP
  source 1..3447: mol_type = other RNA
atgggaaaacttagtccagtttgtctgtatctgtttctgcagtgtctattactatggaatagaggaagtgccagaaacctaaatgaacttaaaatggaatgtccacacactattgggttaggtcaaggccttgtcattggttcagtggaattgccacctgttccaatacaacaagtggagtctctaaaattagaaagctcctgtaattttgacttacacaccagcacagcaacccagcaatcattcacaaagtggacatgggaaatgaaggatgacctagctgaaaacactcaggcatcatcgacaagttttcaaacaaaaagtagtgaagtgaatttaagagggttgtgtttaattccccctttagtggttgaaacagcatcacggacccggaagacaattgcttgttttgacatatcatgtaatcaaacagtatgtcaacctactgtctatttagtaggacctatccaaacatgtattacaacaaaaagctgtcttctgggcttgggtgaccaaagaatccaagtaaattatgagaaaacatactgtgtctcaggtcagttgattgaaggagtgtgttttaaccctgtacacacaagggctctttcccaacctagccatacttatgatatagtgactatgatggtgcgttgttttttggttgtaaagaaagtgacctcaggtgatagtatgaagattgaaaagaactttgagactttagtccagaagactgattgtaatgcaaatggttttcagggctattatatttgtcttgtaggaagtagctcagagccattatatgttccgacattagacgattatcggtctgctgaggttttatcaagaatggcttttgcacctcatggagaagatcatgatgttgaaagaaatgcagtgagtgctttaagaattgtaggtaaggtaactggcaaagcaccttctacagaagcatctgacacagtacaaggcatagctttttcaggtagccccctctatacatctacaggggtattgacagctaaggataacccggtatatatttggtcaccgggaattatcatggaaggaaaccattctgtgtgcgaaaagaagacattaccccttacatggactggattcataccattaccaggtgaaattgaaaaaacacctcagtgcacagtcttttgcaccctggcagggccaggtgccgattgtgaagcttactctgaaaccgggattttcaatataagctcacctacttgtttactcaatcgtgtacagagattccgtggtgcagagcaacagataaaatttgtttgtcaaagagttgatatggacattacagtatattgtaatggtatgaaaaaagtgattctaactaaaactttagttataggccaatgcatatataccttcactagtattttctcgctaatccctgggattgcacattcacttgcagtagaactatgtgttccaggccttcatggctgggctacagtgttgcttttattaaccttttgttttggatggattctcattccattcattgccatgatattactaaaaatactaattgcgtttgcatatttatgttctaaatataatacagactccaagttcaaaattttgattgagaaagtaaagaaggaatatcaaaaaacaatgggctcaatggtttgtgaggtttgtcaatatgaatgtgagacagcaaaagaattagaatctcatcggaaaagctgtccaattggttcctgcccatactgtcttaatccatctgaggcaacaacatcagctcttcaggctcattttaaagtgtgtaaattgacatcaaggtttcaagacaatctaaggaagtcattggcagcttatgaaccaaagcaaggatgttatcggacattatcccttttccgttatcgaagtcgtttctttgtaggattcatctggtgtatactgctggttttagaattggttatttgggctgctagtgctgaaacacaaaatctaaactcaggatggacagatactgcacatggttcaggtgttgttcccatgagaactgacttagaactggatttttcattaccatcttctgcaagttatacatacagaagacaattacagaatcctgcaaatgaacatgaaaagataccctttcacctacaaataagcaaacaagtaatacatgctgaaatacaacatttaggccattggatggatgctacatttaacttaaaaacagcatttcattgctatggcttatgtgaaaagtatgcctatccatggcagacagctggctgtttttttgaaaaagactatgaatttgaaagtggctggggttgtaatcccccagattgcccaggtattggaacaggttgcactgcctgtggtgtatatcttgataaactcaaatcagtgggaaaggtttttaagatcatttcattaagatacacaagaaaggcttgtattcaactcggcactgaacagacctgcaagagtgttgatagtaatgattgcctggtcaccacttcaattaaagtatgcctgattgggactgtctcaaaatttcaaccctcagatacattattatttttgggcccacttgagcaaggtgggttaatatttaaacaatggtgtacaacaacatgtcaatttggtgatcccggggatataatgagtactctgacagggatgaaatgtcctgaacttaatggttcatttaggaagaaatgtgcatttgcaacaacaccagtatgtcagtttgatggaaatacaatatcaggatataagcggatgatggctactaaagattctttccaatcatttaatgtcacagaaccccatatttctacaagtgcacttgaatggattgatccggatagttctcttagagatcatattaatgttgttgtcagccgtgatctctcatttcaggatttgagtgagacaccatgtcaagtagatttaactacatcttcaatagatggagcatggggttcaggtgttggctttaatttagtttgtactgttagtttaacagaatgcccaacttttttaacttccatcaaggcatgtgattctgcaatgtgttatgggtctaccacaaccaacctagtgagaggacagaacacagtccatatcgttgggaagggaggtcattctggttcaaaattcatgtgttgtcatgacacaaagtgctctagtacaggtttgattgcagctgcaccacatttagaccgggtaacagggtttaatcaagcagatagtgataagatattcgatgatggtgcaccaggatgtggcatgtcttgttggtttaaaaaatcaggtgaatggattcttggtgtgttaaacggaaattggttagttgtggctgtcctaatagcactatttatattatccatattcttgtttaccttatgctgccctagaagaccaacctacactaaggaacataagccttaa

SEQ ID NO: 3411 - RNA, 3447 nt, synthetic construct
  misc_feature 1..3447: note = derived and/or modified CDS sequence (wt) from PUUV(CG1820/POR)__KT885051.1__GP
  source 1..3447: mol_type = other RNA
atgggagaacttagtccagtttgtctgtatctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcttgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccttatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgcttaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacattttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 3412 - RNA, 3447 nt, synthetic construct
  misc_feature 1..3447: note = derived and/or modified CDS sequence (wt) from PUUV(DTK/Ufa-97)__AB297666.2__GP
  source 1..3447: mol_type = other RNA
atgggagaacttagtccagtttgtctgtatctgcttctccagggtctattactatgtaatacaggggctgccagaaaccttaatgagcttaaaatggaatgtccacatactgttagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcttgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccttatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgcttaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacattttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacggccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 3413 - RNA, 3447 nt, synthetic construct
  misc_feature 1..3447: note = derived and/or modified CDS sequence (wt) from PUUV(PUU/Cg-Erft)__AJ238778.1__GP
  source 1..3447: mol_type = other RNA
atgggaaaaattattccagtttgtctgtacctgctctttttgtgtctgctactatggaatagaggagatgccagaaacctgaatgaacttaaaattgaatgtccacacacaattggtttgggtcagggccttgttattggatcagttgaattaccacctgttccattaactcaagtggagtctttaaaactggaaagttcatgtaatttcgatctacataccagtacatcatcacaacagccatttacaaaatggacatgggagatgaaaagtgacctggcagaaaatacacaggcatcgtctacaagttttcaaacaaaaagtagtgagataaacttacgtggtttatgcttggttcctcctttggtgattgaaactgctgcaaggactcgaaaaacaatagcgtgttttgacttgtcctgtaatcagacagcatgtcagcctactgtctttttaataggcccaatacaaacatgcataacaacaaaaagttgccttttgggtttaggtgatcagaggattcaggttaattatgaaaaaacatattgtgtttcaggtcaactcgttgagggtgtctgttttaatccagtacataccatggccttatctcaacctagccacacatatgacatagtaactgttatggtgcgttgttttttgatcgcaaaaaaggtctcaacaggtgatagtatgaagcttgaaaaaagcttcgagactcttgtccaaaaaactagctgtacaggcaatggttttcaaggttattatatctgtttagtaggaagtagttctgaacccctatatattccaacattggatgattacaggtcagctgaggtcctttcaaggatggcatttgcaccacatggggaagatcatgatgttgaaaaaaatgctataagtgcaatgaggattattgggaaagtgacaggcaaggcaccatcaactgagtcatctgatacaatacagggcgttgccttttcagggaaccctctttacacatcgactggggtcttaacagcaaaggatgaccctgtatatatttgggcacctggaattataatggaaggaaaccactcagtttgtgacaaaaaaacgttgcctctcacatggactggttttataccactaccaggagaaattgaaaagacaacacagtgtactgtattctgtacattagctggacctggtgcagattgtgaagcttattctgaaacaggaatattcaacataagttctccaacctgtttaattaatcgtgtgcagagattccgtggtgctgaacagcaaatcaaattcatttgccagagggttgatatggatattacggtgtactgtaacgggctgaagaaagtgattcttaccaaaactttaatcattggacagtgtatctatacttttacaagcattttttctttaatccctggggttgctcattcattagctgtggaattatgtgtgccaggtctccatggctgggccacaatgctacttttattaacattttgcttcgggtggattttaataccatttttttccatgatattgttaaaaatcttgattgcatttgcttacttatgctcaaaatataacacagactcaaagtttaaaatattaatagagaaagttaaaaaagaatatcaaaaaaccatgggctccatggtatgtgaggtttgtcattatgagtgtgaaactgcaaaagaactggaatcacatagaaaaagttgcccaatgggttcatgtccatattgtctgaatcctgctgaagcaacaacatctgctttgcaggcccattttaaagtgtgtaagctcacatcaaggtttcaggacaatttaagaaagtcattgggggcatatgaaccgaaacagggctgttacagaacattgtcccttttccgttatagaagcaggtttttcgtgggttttatttggtgtttgttattagtcttagaattaattgtgtgggctgctagtgctgaaactcagaatcttaattctgggtggacagacacagcacatggatctggaataatacctatgaggactgacctggaattagacttctctctcccatcttcggccagttatacatatagaagacagttacaaaatccagcaaatgaacaagagaaaataccatttcatttgcagataagtaaacaggtaatccatgcagagattcaacatttaggtcattggatggatggcacatttaatttgaaaaccgcatttcactgttatggttcttgtgaaaagtatgcatacccatggcagacagcaggctgtttcatagaaaaagattatgagtatgaaagtggctggggatgtaacccaccagattgtccaggggtagggactggatgtacagcatgtggtgtgtatttagataagttaaaatcagtgggtaaagcattcaaaattgtatctttgagatacacaaggaaagcatgtattcagcttggtactgaacaaacttgtaaaagtgtagatagtaatgattgcttggtgactacatcagtcaaggtgtgtttaattggaacagtgtcaaagtttcaaccatcagatactctattatttttaggtccacttgaacaaggcgggttgatcttcaagcagtggtgcactacaacatgtcaatttggtgacccaggggatataatgagcactccagtcggaatgaagtgccctgagttaaatggttcattcagaaaaaaatgcgcatttgcaacaacacctgtttgccaatttgatggaaatactctttctggctacaaacgaatgattgctacaaaggattcatttcagtcattcaatgtcacagaacctcatatttctgcaagctcacttgaatggattgaccctgacagttctttgagagatcatattaatgttattgtaggacgtgatctctcttttcaagacctaagtgaaacaccctgtcaggtagacttagcaacaacatcaattgatggggcatggggttcaggagtaggttttaatttagtttgttcagtgagcctgacagagtgttctacatttttaacttcaatcaaggcatgtgactcagcaatgtgttatggctctacaacagccaatcttttaagagggcaaaatacagttcatattgtaggaaaaggaggacattctgggtctaaattcatgtgttgtcatgacacaaagtgctcaagcactggtctggttgcagctgcgccacatttagatcgtgtgacaggatataatcaagcagacagtgacaagatctttgatgatggtgcccctgaatgcggtatatcttgctggttcacaaaatcaggagaatggattcttggagttctgaacgggaattggatggtagtggctgtgttagtggcattattcatattatccattttcctctttacattatgttgtccacggaggcctagttatgcaaaagaacataaaccttag

SEQ ID NO: 3414 - RNA, 3447 nt, synthetic construct
  misc_feature 1..3447: note = derived and/or modified CDS sequence (wt) from PUUV(PUUV/Konnevesi/Mg_M105A/2005)__JQ319173.1__GP
  source 1..3447: mol_type = other RNA
atgggaaaatctagtccagtttgtctgtatctgattcttcagggtctattactaattggtgcagtaaatgccagaaatctaaatgaacttaaaatggaatgtccgcatacaattgggttaggtcaaggccttgttgtaggctcagtagaactaccacctgtcccaatacagcaagttgagtccttgaaattagaaagttcttgcaattttgatttgcataccagtacagcaggacaacaatcatttacaaagtggacatgggagacaaaaagtgatcttgcagaaaatacacaagcatcatcaacaagttttcagacaaaaagtagtgaggttaacttgagaggtctatgcttaatccctactttagtggttgaaacagcagcaaggatgcggaagacaatagcatgttatgacttatcatgcaaccaaacagtatgtcagcctactgtttatctaatggggcccattcaaacttgcttaacaactaaaagttgtcttttggggttaggggatcaacgaatccaggtgaattatgagaggacatattgtgtttcagggcagcttgttgaaggtgtctgctttaacccaatacatacaatggctctttcccagcctagccatacttatgatatagtgactgtaatggttcgttgttttctggtcataaaaaaggtgacatctggtgatagtatgaagattgaaaaaaactttgagactcttgttcagaaaactggttgtacagccaacagttttcaaggatactacatatgtcttgtgggaagtagttcagaaccattgtatgttcctacacttgatgattaccgatcagccgaggttttatcacgaatggcttttgcaccacatggagaagatcatgatatagaaaagaatgcaattagtgccttgcgtattgctggcaaagtaacaggtaaggcaccatctactgaatcatcagacacagttcaaggtattgcattttcaggtagtcctctttatacatctactggtgtgttaacagcaaaagatgatcccgtgtatatttgggccccagggattatcatggaagggaaccactctgtctgtgaaaaaaagacactgcctttaacatggactggattcatcccattacctggggagatcgaaaaaacaacacagtgtacagttttttgtactttagcaggaccgggtgcagattgtgaggcatattctgagacaggtattttcaatataagttcacctacttgcctgataaaccgtgttcaaagattccgtggtgcagaacaacaaataaagtttgtctgtcaaagagtggacatggatatcactgtatattgcaatggagtaaaaaaagtcatccttactaaaactctagttatcggacagtgcatttatacttttacaagcatcttttccttaatcccaggaattgcacattctcttgctgttgagctatgtgtgccaggccttcatggttgggctacagtattgcttttattaacattttgctttggctgggttttgataccaactatcacaatgatactgttaaaaatattgattgcatttgcatatctctgctctaaatataatacagactccaagtttaagattttggttgaaaaagtaaaaaaagaatatcagaagactatgggttcaatggtttgtgaggtatgccaatatgagtgtgagaccgctaaagagctagaatcacataggaagagttgttctattggttcatgcccttattgtcttaatccatctgaagcaacaccgtctgctcttcaggctcattttaaagtttgtaaattaacatcaaggtttcaggaaaatttaaaaaagtcactaacaatgtatgagccaatgcagggttgctatcgaacattgtctttgtttaggtatcgcagtagattctttgtaggtctagtatggtgtatgttgcttgttttagagctgattgtatgggctgctagtgcagaaacacaaaacttaaatgctggttggactgatacagcacatggatcagggattatcccgatgaaagctgacttggaattagatttttcacttccatcatctgctagctatacctaccgaagacaattacagaacccggccaatgaacaagaaaaaataccattccatcttcagataagtaaacaggtaatccatgcagaaattcagcacttaggccattggatggatgctacatttaacttgaaaactgcttttcattgttatggttcatgtgaaaaatatgcctatccctggcaaacagcagggtgttttgttgagaaagattatgaatatgagactggttggggctgtaaccctcctgactgccctggtgtaggaacaggctgtaccgcatgcggtgtatacctagataaattgaaatcagttggaaaggtctttaaaattgtgtctttaaggtatacaaggaaagtatgcattcaactaggcacagaacagacctgtaaaactgttgacagtaatgattgcttgataactacatcagttaaagtgtgcttgataggaaccatttcgaaatttcaaccttctgacacccttttatttcttggtcctctccaacaaggtgggttgatctttaaacaatggtgtaccactacatgtcaatttggcgatcctggagacataatgagcacaccgacaggaatgaagtgtccagaactaaatggttcatttagaaaaaaatgtgcatttgcaacaacacctgtatgtcaatttgatggaaatacaatttcaggttataagcggatgattgcaacaaaagattcttttcaatcatttaatgtaacagaaccacatatctctacaagtgcattggagtggattgatccagatagttcacttcgggatcacatcaatgtgattgtaagccgtgatttatcgttccaggatttgagtgaaacaccttgtcaaatagatttgacagcatcagctatagatggggcatggggttcaggagttggctttaatctagtttgtactattagtttaacagaatgctctacatttttaacctcaattaaagcatgtgatgctgctatgtgttatggttctactacaaccaacttagttagagggcagaatacaatccatgttgttggtaagggtggacattctggttcaaagttcatgtgctgtcatgatacgaaatgctctagcacagggttagtcgcagctgcaccacatttaaatcgtgtgacagggtttaatcaggcagatagtgataagatttttgatgatggagcaccagaatgtggtgtgtcatgttggtttaaaaaatcaggagaatgggtccttggagtgctcaatggaaattggatggtagtagctgtattgatagcattattgatattgtcaatcttcttatttgcattgtgttgtccgcgcaggcctagttataagaaagaacacaaaccttaa

SEQ ID NO: 3415 - RNA, 3447 nt, synthetic construct
  misc_feature 1..3447: note = derived and/or modified CDS sequence (wt) from PUUV(PUUV/Konnevesi/Mg_M114B/2005)__JQ319175.1__GP
  source 1..3447: mol_type = other RNA
atgggaaaatctagtccagtttgtttgtatctgattcttcagggtctattactatttggtgcagtaaatgccagaaatctgaatgaacttaaaatggaatgtccgcatacaattggattaggtcaaggtcttgttgtaggctcagtggaactaccacctgtcccaatacagcaagttgaatccttgaaattagaaagttcttgcaattttgatttgcacaccagtacagcaggacaacaatcatttacaaagtggacatgggaaataaaaaatgatcttgcagaaaatacacaagcatcatcaacaagttttcagacaaaaagtagtgaggttaacttaagaggtctgtgcttgatccctactttagtggttgaaacagcagcaaggatgcggaagacaatagcatgttatgacttgtcatgcaaccaaacagtatgtcaacctactgtttatctaatggggcccattcaaacttgcttaacaactaaaagttgtcttttgggtttaggggatcaacgaatccaggtgaattatgaaaggacatattgtgtatcagggcagcttgttgaaggtgtctgctttaacccgatacatacaatggctctttcccagcctagccatacttatgatatagtgactataatggttcgttgttttttggtcataaaaaaggtgacatctggtgataatatgaagattgaaaagaactttgagactcttgttcagaaaactggttgcacagccaacagttttcaagggtattacatatgtcttgtgggaagtagttcagaaccattgtatgttcctacactcgatgattaccgatcagctgaggttttatcacgaatggcttttgcaccacatggagaagatcatgatatagaaaagaatgcaatcagtgctttgcgtatcgctggcaaagtaacaggtaaggcaccttctactgaatcatcagacacagttcaaggtattgcattttcaggtagtcctctttatacatctactggtgtgttaacagcaaaagatgatcctgtgtatatttgggccccagggattatcatggaaggaaaccactctgtctgtgaaaaaaagacactgcctttaacatggactgggttcatccctttacctggggagattgaaaaaacaacacagtgtacagttttttgtactttagcaggaccaggtgcagattgtgaggcatattctgagacaggtatttttaatataagttcacctacttgcctgataaaccgtgtccaaagattccgtggtgcagaacaacaaataaagtttgtctgtcaaagagtggacatggatatcactgtatattgcaatggagtaaaaaaagtcatccttactaaaaccctagttattggacagtgcatttatacttttacaagtatcttttccttaatcccaggaattgcacattctcttgctgttgagctatgtgtgccaggccttcatggttgggctacagtattgcttctattaacattttgctttggctgggttttgataccaaccatcacaatgatactattgaaaatattgattgcatttgcatatctttgctctaaatataatacagattccaagtttaagattttggttgaaaaagtaaaaaaagaatatcagaagactatgggttcaatggtttgtgaagtgtgccaatatgagtgtgagactgctaaagagctagaatcacataggaagagttgttcaattggttcatgcccttattgtcttaatccatctgaagcaacaccgtctgctcttcaggctcattttaaagtttgtaaattaacatcaaggtttcaggaaaatttaaaaaagtcactaacaatgtatgagccaatgcagggttgctatcgaacattatccttgtttaggtatcgcagtagattctttgtaggtttagtgtggtgtatgttgcttgttttagagctgattgtgtgggctgctagtgcagaaacacaaaacttaaatgctggttggactgatacagcacatggatcggggataatcccaatgaaagctgatctggaattggatttctcacttccatcatctgctagttatacctaccggagacaattacaaaacccagccaatgaacaagaaaaaataccattccatcttcagataagtaaacaggtaatccatgcagaaattcagcacttaggccattggatggatgctacatttaacttgaaaactgcttttcattgttatggttcatgtgaaaaatatgcctatccctggcaaacagcagggtgttttgttgagaaagattatgaatatgagactggttggggctgtaaccctcctgactgccctggtgtaggaacaggctgtaccgcatgcggtgtatacctagataaattgaaatcagttggaaaggtctttaaaattgtgtctttaaggtatacaaggaaagtatgcattcaactaggcacagaacagacctgtaaaactgttgacagtaatgattgcttgataactacatcagttaaagtgtgcttgataggaaccatttcgaaatttcaaccttctgacacccttttatttcttggtcctctccaacaaggtggcttaatctttaagcaatggtgtaccactacatgtcaatttggtgatcctggagacatcatgagcacaccaacaggaatgaagtgtccagaactaaatggttcatttagaaagaaatgtgcatttgcgacaacacctgtatgtcaatttgatggaaatacaatttcaggttataagcggatgattgcaacaaaagattctttccaatcatttaatgtaacagaaccacacatttctacaagtgcattggagtggattgatccagatagttcacttcgggatcacatcaatgtgatcgtaagccgtgatttatcattccaggatttaagtgaaacaccttgtcaaatagatttgatagcatcagctatagatggggcatggggttcaggagttggctttaatctagtttgcactgttagtttaacagaatgctctacatttctaacctcaattaaagcatgtgatgctgctatgtgttatggttctactacaattaacttaattagagggcagaatacaatccatgttgttggtaagggtggacattctggctccaagtttatgtgttgtcatgacacgaaatgctctagcacagggttagtcgcagctgcaccacatctagatcgtgtgacagggtttaatcaggcagatagtgataagatctttgatgatggtgctccagagtgtggtgtgtcttgttggtttaaaaaatcaggagagtgggtccttggagtgctcaatgggaattggatggtagtggctgtattgatagcattactgatattgtctatcttcttatttgcactgtgttgcccacgcaggcctagttataagaaagaacacaaaccttaa

SEQ ID NO: 3416 - RNA, 3447 nt, synthetic construct
  misc_feature 1..3447: note = derived and/or modified CDS sequence (wt) from PUUV(PUUV/Konnevesi/Mg_M78B/2005)__JQ319174.1__GP
  source 1..3447: mol_type = other RNA
atgggaaaatctagtccagtttgtctgtatctgattcttcagggtctattactatttggtgcagtaaatgccagaaatctgaatgaacttaaaatggaatgtccgcatacaattgggttaggtcaaggtcttgttgtaggctcggtagaactaccacctgtcccgatacagcaagttgaatccttgaaattagaaagttcttgcaattttgatttgcacaccagtacagcaggacaacaatcatttacaaagtggacatgggaaataaaaaatgatcttgcagaaaatacacaagcatcatcaacaagttttcagacaaaaagtagtgaggttaacttaagaggtctgtgcttgatccctactttagtggttgaaacggcagcaaggatgcggaagacaatagcatgttatgacttgtcatgcaaccaaacagtatgtcaacctactgtttatctaatggggcccattcaaacttgcttaacaactaaaagttgtcttctgggtttaggggatcaacgaatccaggtgaattatgaaaggacatattgtgtttcagggcagcttgttgaaggtgtctgctttaacccaatacatacaatggctctttcccagcctagccatacttatgatatagtgactataatggtccgttgttttctggtcataaaaaaggtgacatctggtgataatatgaagattgaaaagaactttgagactcttgttcagaaaactggttgcacagccaacggttttcaagggtattacatatgtcttgtggggagtagttcagaaccgttgtatgttcctacacttgatgattatcgatcagctgaggttttatcacgaatggcttttgcacctcatggagaagatcatgacatagaaaagaatgcaattagtgctttgcgtattgctggcaaagtaacaggtaaggcaccgtctaccgaatcatcagacacagttcaaggtattgcattttcaggtagtcctctttacacatctactggtgtattaacagcaaaagatgatcctgtgtatatttgggccccaggtatcatcatggaaggaaaccactctgtctgtgaaaaaaagacactgcctttaacatggactgggttcatcccattacctggggagattgaaaagacaacacagtgtacagttttttgtactttagcaggaccgggtgcagattgtgaggcatattctgagacaggtattttcaatataagctcacctacttgcctgataaaccgtgtccaaagattccgtggtgcaaaacaacaaataaagtttgtctgtcaaagagtagacatggatatcactgtatattgtaatggagtaaaaaaagttatccttactaaaaccctagttatcggacagtgcatttatacttttacaagtatcttttccttaatcccaggaattgcacattctcttgctgttgagctatgtgtgccaggccttcatggttgggctacagtattgcttttattaactttttgctttggctgggttttgataccaactatcacaatgatactattaaaaatattgattgcatttgcatatctttgctctaaatataatacagattccaagtttaagattttggttgaaaaagtaaaaaaagaatatcagaagactatgggttcaatggtttgtgaagtatgccaatatgagtgtgagactgctaaagagctagaatcacataggaagagttgttcaattggttcatgcccttattgtcttaatccatctgaggccacaccgtctgctcttcaggctcattttaaagtttgtaaattaacatcaaggtttcaggaaaatttaaaaaagtcactaacaatgtatgagccaatgcagggttgctatcgaacattatccttgtttaggtatcgcagtagattctttgtaggtttagtgtggtgtatgttgcttgttttagagctgattgtgtgggctgctagtgcagaaacacaaaacttaaatgctggttggactgatacagcacatggatcggggataatcccaatgaaagctgatttggaattggatttctcacttccatcatctgctagttatacctaccgtagacaattacaaaacccagccaatgaacaagaaaaaataccattccatctgcagataagtaaacaggtaattcatgcagagattcagcacttaggccattggatggatgctacatttaacttgaaaactgcttttcattgttatggttcatgtgaaaaatatgcctacccctggcaaacagcaggttgttttgttgagaaagattatgaatatgagactggttggggctgtaaccctcctgattgccctggtgtaggaacaggctgtactgcttgcggtgtatacctagataaattgaaatcagttggaaaggtctttaagattgtgtctttaagatatacaaggaaggtatgcattcaattaggcacagaacagacctgtaaaactgttgacagtaatgattgcttaataactacatcagttaaagtgtgtttgataggaaccatttctaaatttcaaccttctgacacccttttattcctcggtcctctccaacaaggtggcttaatctttaagcaatggtgtaccactacatgtcaatttggtgatcctggagacataatgagcacaccaacaggaatgaagtgtccagaactaaatggttcatttagaaagaaatgtgcatttgcgacaacacctgtgtgtcaatttgatggaaatacaatttcaggttataagcggatgattgcaacaaaagattcttttcaatcatttaatgtaacagaaccacacatctctacaagtgcattggagtggattgatccagatagttcactccgggatcacatcaatgtgatcgtaagccgtgatttatcgttccaggatttaagtgaaacaccttgtcaaatagatatgacagcatcagctatagatggggcatggggttcaggagttggctttaatctagtttgcactgttagtttaacagaatgctctacattcctaacctcaattaaagcatgtgatgctgctatgtgttatggttctactacaactaacttagttagagggcagaatacaatccatgttgttggtaagggtggacattctggctcaaagtttatgtgttgtcatgacacgaaatgctctagcaaagggttagtcgcagctgcaccacatctagatcgtgtgacagggtttaatcaggcagatagtgataagatctttgatgatggtgctccagagtgtggtgtatcttgttggtttaaaaaatcaggagagtgggtccttggagtgctcaatgggaattggatggtagtggctgtattgatagcattactgatactgtctatcttcttatttgcattatgttgtccacgcaggcctagttataagaaagagcacaaaccttaa

SEQ ID NO: 3417 - RNA, 3447 nt, synthetic construct
  misc_feature 1..3447: note = derived and/or modified CDS sequence (wt) from PUUV(PUUV/Konnevesi/Mg_O78A/2005)__JQ319172.1__GP
  source 1..3447: mol_type = other RNA
atgggaaaatctagtccagtttgtctgtatctgattcttcagggtctattactatttggtgcagtaaatgccagaaatctgaatgaacttaaaatggaatgtccgcatacaattgggttaggtcaaggccttgttgtaggctcagtagaactaccacctgtcccaatacagcaagttgagtccttgaaattagaaagttcttgcaattttgatttgcataccagtacagcaggacaacaatcatttacaaagtggacatgggagataaaaagtgatcttgcagaaaatacacaagcatcatcaacaagttttcagacaaaaagtagtgaggttaacttgagaggtctgtgcttgatccctactttagtggttgaaacagcagcaaggatgcggaagacaatagcatgttatgacttatcatgcaaccaaacagtatgtcagcctactgtttatctaatggggcccatccaaacttgcttaacaactaaaagttgtcttttgggtttaggggatcaacgaatccaggtgaattatgagaggacatattgtgtttcagggcagcttgttgaaggtgtctgctttaacccaatacatacaatggctctttcccagcctagccatacttatgatatagtgactataatggttcgttgttttctggtcataaaaaaggtgacatctggtgatagtatgaagattgaaaaaaactttgagactcttgttcagaaaactggttgtacagccaacagttttcaaggatattacatatgtcttgtgggaagtagttcagaaccattgtatgtccctacacttgatgattatcgatcagctgaggttttatcacgaatggcttttgcacctcatggagaagatcatgatatagaaaagaatgcaattagtgccttgcgtattgctggcaaagtaacaggtaaggcaccatctacagaatcatcagacacagttcaaggtattgcattttcaggtagtcctctttatacatctactggtgtgttaacagcaaaagatgatcctgtgtatatttgggccccagggattatcatggaagggaaccattctgtctgtgaaaaaaagacactgcctttaacatggactggattcatcccattacctggggagattgaaaaaacaacacagtgtacagttttttgtactttagcaggaccgggtgcagattgtgaggcatattctgagacaggtattttcaatataagttcacctacttgcctgataaaccgtgttcaaagattccgtggtgcagaacaacaaataaagttcgtctgtcaaagagtggacatggatatcactgtatattgcaatggagtaaaaaaagtcatccttactaaaactctagttattggacagtgcatttatacttttacaagcatcttttccttaatcccaggaattgcacattctcttgctgttgagctatgtgtgccaggccttcatggctgggctacagtattgcttttattaacattttgctttggctgggttttaataccaactatcacaatgatactgttaaaaatattgattgcatttgcatatctttgctctaaatataatacagattctaagtttaagattttggttgaaaaagtaaaaaaagaatatcagaagactatgggttcaatggtttgtgaggtatgccaatatgagtgtgagaccgctaaagagctagaatcacatagaaagagttgttctattggttcatgcccttattgtcttaatccatctgaagcaacaccgtctgctcttcaggctcattttaaagtttgtaaattaacatcaaggtttcaggaaaatttaaaaaagtcactaacaatgtatgagccaatgcagggttgctatagaacattgtctttgtttaggtatcgcagtagattctttgtaggtctagtatggtgtatgttgcttgtcttagagctgattgtatgggctgctagtgcagaaacacaaaacttaaatgctggttggactgatacagcacatggatcggggataatcccaatgaaagctgatctggaattggatttctcacttccatcatctgctagttatacctaccggagacaattacaaaacccagccaatgaacaagaaaaaataccattccatctgcagataagtaaacaggtaatccatgcagaaattcagcacttaggccattggatggatgctacatttaacttgaaaactgcttttcattgttatggttcatgtgaaaaatatgcctatccctggcaaacagcagggtgttttgttgagaaagattatgaatatgagactggttggggctgtaaccctcctgactgccctggtgtaggaacaggctgtactgcttgcggtgtatacctagataaattgaaatcagttggaaaggtctttaaaattgtgtctttaaggtatacaaggaaagtatgcattcaactaggcacagaacagacctgtaaaactgttgacagtaatgattgcttgataactacatcagttaaagtgtgcttgatagggaccatttcgaaatttcaaccttctgacacccttttattcctcggtcctctccaacaaggtggcttgatctttaaacaatggtgtaccactacatgtcaatttggtgatcctggagacataatgagcacaccaacaggaatgaagtgtccagaactaaatggttcatttagaaagaaatgtgcatttgcgacaacacctgtatgtcaatttgatggaaatacaatttcaggttataagcggatgattgcaacaaaagattcttttcaatcatttaatgtaacagaaccacacatctccacaagtgcattggagtggattgatccagatagttcacttcgggatcacatcaatgtgattgtaagccgtgatttatcgttccaggatttgagtgaaacaccttgtcaaatagatttgacagcatcagctatagatggggcatggggttcaggagttggctttaatctagtttgtactattagtttaacagaatgctctacatttttaacctcaattaaagcatgtgatgctgctatgtgttatggttctactacaaccaacttagttagagggcagaatacaatccatgttgttggtaagggtggacattctggttcaaagtttatgtgctgtcatgatacgaaatgctctagcacagggttagtcgcagctgcaccacatttaaatcgtgtgacagggtttaatcaggcagatagtgataagatctttgatgatggtgctccagagtgtggggtgtcttgttggtttaaaaaatcaggagaatgggtccttggagtgctcaatggaaattggatggtagtagctgtattgatagcattgttgatattgtctatcttcttatttgcattgtgttgtccacgcaggcctagttataagaaagaacacaaaccttaa

SEQ ID NO: 3418 - RNA, 3447 nt, synthetic construct
  misc_feature 1..3447: note = derived and/or modified CDS sequence (wt) from PUUV(PUUV/Pieksamaki/human_kidney/2008)__JN831951.1__GP
  source 1..3447: mol_type = other RNA
atgggaaaatctagtccagtttgtctgtatctgattcttcagggtctattactatttggtgcagtaaatgccagaaatctgaatgaacttaaaatggaatgtccgcatacaattgggttaggtcagggccttgttgtaggctcagtagaactaccacctgtcccaatacagcaagttgagtccttgaaattagaaagttcttgcaattttgatttgcataccagtacagcaggacaacaatcatttacaaagtggacatgggagataaaaagtgatcttgcagaaaatacacaagcatcatcaacaagttttcagacaaaaagtagtgaggttaacttgagaggtctgtgcttgatccctactttagtggttgaaacagcagcaaggatgcggaagacaatagcatgttatgacttatcatgcaaccaaacagtatgtcagcctactgtttatctaatggggcccattcaaacttgcttaacaactaaaagttgtcttttgggtttaggggatcaacgaatccaggtgaattatgagaggacatattgtgtttcagggcagcttgttgaaggtgtctgttttaacccaatacatacaatggctctttcccaacctagccatacttatgatgtagtgactataatggttcgttgttttcttgtcataaaaaaggtgacatctggtgatagtatgaagattgaaaaaaactttgagactcttgttcagaaaactggttgcacagccaacaattttcaaggatactacatatgtcttgtgggaagtagttcagaaccattgtatgttcctacacttgatgattatcgatcagctgaggttttatcacgaatggcttttgcaccacatggggaagatcatgatatagaaaagaatgcaattagtgccttgcgtattgctggcaaagtaacaggcaaggcaccatctactgaatcatcagacacagttcaaggtattgcattttcaggtagtcctctttatacatctactggtgtgttaacagcaaaagatgatcctgtgtatatttgggccccagggattattatggaagggaaccactctgtctgtgaaaaaaagacactgcctttaacatggactggatttatcccattgcctggggagattgaaaaaacaacacagtgtacagttttttgtactttagcaggaccgggtgcagattgtgaggcatattctgagacaggtattttcaatataagctcacctacttgcctgataaaccgtgttcaaagattccgtggtgcagaacaacaaataaagtttgtctgtcaaagagtggacatggatatcactgtatattgcaatggagtaaaaaaagtcatccttactaaaactctagttatcggacagtgcatttatacttttacaagcatcttttccttaatcccaggaattgcgcattctcttgctgttgagctatgtgtgccaggccttcatggttgggctacagtattgcttttattaacattttgctttggctgggttttgataccaactatcacaatgatactgttaaaaatattgattgcatttgcatatctttgctctaaatataatacagattccaagtttaagattttggttgaaaaagtaaaaaaagaatatcagaagactatgggttcaatggtttgtgaagtatgccaatatgagtgtgagaccgctaaagagctagaatcacataggaagagttgttctattggttcatgcccttattgtcttaatccatctgaagcaacaccgtctgctcttcaggctcattttaaagtttgtaaattaacatcaaggtttcaggaaaatttaaaaaagtcactaacaatgtatgagccaatgcagggttgctatcgaacattgtctttgtttaggtatcgcagtagattctttgtaggtctagtatggtgtatgttgcttgttttagagctgattgtatgggctgctagtgcagagacacaaaacttaaatgctggttggactgatacagcacatggatcagggattatcccgatgaaagctgacttggaattagatttttcacttccatcatctgctagctatacctaccgaagacaattacaaaacccggccaatgaacaagaaaaaataccattccatctgcagataagtaaacaggtaatccatgcagaaattcagcacttaggccattggatggatgctacatttaacttgaaaactgcttttcattgttatggttcatgtgaaaaatatgcctatccctggcagacagcagggtgttttgttgagaaagattatgaatatgagactggttggggctgtaaccctcctgactgccctggtgtaggaacaggctgtactgcttgcggtgtatacctagataaattgaaatcagttggaaaggtctttaaaattgtgtctttaaggtatacaaggaaagtatgcattcaactaggcacagaacagacctgtaaaactgttgacagtaatgattgcttgataactacatcagttaaagtgtgcttgatagggaccatttcgaaatttcaaccttctgacacccttttatttcttggtcctctccaacaaggtggcttgatttttaaacaatggtgtaccactacatgtcaatttggtgatcctggagacataatgagcacaccaacaggaatgaagtgtccagaactaaatggttcatttagaaagaaatgtgcatttgcaacaacacctgtatgtcaatttgatggaaatacaatttcaggttataagcgaatgattgcaacaaaagattcttttcaatcatttaatgtgacagaaccacacatctctacaagtgcattggagtggattgatccagatagttcacttcgggatcacatcaatgtgattgtaagccgtgatttatcgttccaggatttgagtgaaacaccttgtcaaatagatttgacagcatcagctatagatggggcatggggttcaggagttggctttaatctagtttgtactattagtttaacagaatgctctacatttttaacctcaattaaagcatgtgatgctgctatgtgttatggttctactacaaccaacttagttagagggcagaatacaatccatgttgttggtaagggtggacattctggttcaaagtttatgtgctgtcatgatacgaaatgctctagcacagggttagtcgcagctgcaccacatttagatcgtgtgacagggtttaatcaggcagatagtgataagatctttgatgatggtgctccagagtgtggtgtgtcttgttggtttagaaaatcaggagaatgggtccttggagtgctcaatggaaattggatggtagtagctgtattgatagcattattgatattgtctatcttcttatttgcattgtgttgtccacgcaggcctagttataagaaagaacacaaaccttaa

SEQ ID NO: 3419 - RNA, 3447 nt, synthetic construct
  misc_feature 1..3447: note = derived and/or modified CDS sequence (wt) from PUUV(Samara_49/CG/2005)__AB433850.2__GP
  source 1..3447: mol_type = other RNA
atgggaaaacttagtccagtttgtctgtatctgcttctccagggtctattactatgtaagacagggactgccagaaacctaaatgagcttaaaatggaatgtccacatactattgggttaggtcaaggccttgttgtaggatcagtggaactaccgcctgtcccaatacagcaggtggaaacattgaagctggaaagttcttgtaattttgatttgcatactagtacagcaggacaacaagcatttacaaagtggacatgggagataaaaggtgaccttgcagagaatacacaggcatcatcaacaagtttccaaacaaagagtagtgaggtaaacttaaggggactatgtctgattccaactctagttattgagacagcagcaaggatgcggaaaacaatagcatgctatgatctatcatgtaatcaaacagtgtgccagcctactgtgtatcttatgggacccatccaaacttgcataacaactaagagttgccttttgggcctaggcgatcaaagaattcaggtgaattatgaaaagacatactgtgtttcagggcagttggttgaaggtgtctgttttaatccaatacatacaatggctctttctcagccaagccatacttatgatatagttactatgatggttcgttgttttctagttataaaaaaggtgacatctggtgatagtatgaagattgaaaagaattttgagactcttgtccagaaaaacggctgtacagctaatagttttcaaggttattacatctgtcttatcgggagtagctcagagccactgtatgttccaacactggatgactaccgttctgctgaagtcctttcaagaatggcatttgcacctcatggggaagatcatgatgttgaaaaaaatgcaataagtgccttacgtattgctggaaaagtaacagggaaagcaccatccactgagtcttctgatacagtacagggtattgcattttcgggtagccctctttatacatctactggggttttaacagcaaaggatgatcctgtgtacatttgggccccaggcataatcatggaagggaatcactctgtttgtgagaaaaagaccttaccccttacatggactgggtttatctcactacctggcgaaattgaaaagacaacacaatgtacagttttctgcaccctggctggaccaggtgcagactgtgaagcttattcagaaacaggtatttttaatataagctcaccaacatgcttgattaatcgtgtacagaggttccgtggtgcagagcaacaaataaaatttgtttgtcagagggttgatatggatatcactgtgtattgtaatggagttaagaaagtcattctcaccaaaaccttagttattggacagtgtatttacacatttactagtatattctctttaattccaggtgttgcacattcccttgctgttgaactatgtgtgccaggtcttcatggttgggcaaccatgttattattgctaacattttgctttggctgggttctaataccaaccattacaatgatattgctgaaaatattaatcgcatttgcctatctatgttctaaatataatacagattcaaaattcaggatcttgattgaaaaagtgaaaagagaatatcaaaaaacaatgggctcgatggtctgtgaggtatgtcaatatgagtgtgaaactgcaaaggagctagagtcacacaagaaaagctgttcaattggttcgtgtccctattgtcttaacccgtctgaggcaacaacatctgcccttcaagcccattttaaagtctgtaaactcacatcacgattccaggagaatttgagaaagtcattaacagtatacgagcccatgcagggttgttatcgcacattatctctctttaggtatcggagtcggttttttgttggtttagtctggtgtgtgctattagttttagaattaattgtgtgggctgccagtgctgagacacagaatttgaatgcaggctggactgatacagcacacggatctgggataatacctatgaaaactgatcttgaattggacttctctcttccttcatcagcaagttatacatataggagacagctacagaatccagctaatgaacaagaaaatataccatttcatctacagataagtaagcaggtaattcatgcagaaatacaacatttaggtcattggatggatgctacatttaatctgaagactgcatttcattgttatggttcatgtgaaaaatatgcttatccctggcagactgctggttgttttgtagaaaaagattatgagtacgaaactggttggggatgtaatccacctgattgcccaggagtagggactggctgtactgcctgtggggcctatcttgataaattaaaatcagtcgggaaagtcttcaaaattgtgtccttaaggtataccaggaaagtgtgcattcaattaggcactgaacaaacctgtaaaactgttgatagcaatgactgtttaataactacttcagttaaagtgtgtttaatagggacaatttcaaaatttcaaccctctgatactctcttattcctaggtcctctccaacagggtggtttaatatttaagcaatggtgcaccacaacatgtcaatttggtgaccctggagatataatgagtacacccacagggatgaaatgtccggatttaaatgggtcctttagaaaaaaatgtgcatttgcaacaacacctgtgtgccaattcgatggaaatacaatctcaggatataaaaggatgattgctacaaaagattcattccaatctttcaatgttacagaacctcacatatctgcaagtgcattagaatggatcgatcctgacagttcacttcgagatcacataaatgtgattgtaagtcgtgatttatcttttcaagatctaagtgaaacaccatgtcaaatagacctttcaacagcatccatagatggggcatggggttcaggggttggctttaatctggtttgtactgttagcttaacagaatgttctgcatttcttacttcaattaaagcatgtgatgccgcaatgtgctatggatctactacagctaacctaattaggggacaaaataccattcacattgttgggaagggtgggcattctggttcaaagtttatgtgctgtcatgacacaaaatgctctaccactggtcttgttgcagctgcgccacatttagaccgtgtaacaggatacaatcaagcagatagtgataaaatctttgatgatggtgcaccagagtgtggtatgtcttgctggttcaaaaaatctggtgaatggattcttggggtcctcaatggaaattggatggtggtggctgtattgatagcattgttagttttatctatccttctgttcacattatgctgcccacgcagaccaagttacagaaaagagcataaaccttag

SEQ ID NO: 3420 - RNA, 3447 nt, synthetic construct
  misc_feature 1..3447: note = derived and/or modified CDS sequence (wt) from PUUV(Samara_94/CG/2005)__AB433852.2__GP
  source 1..3447: mol_type = other RNA
atgggaaaacttagtccagtttgtctgtatctgcttctccagggtctattactatgtaatacagggactgccagaaacctaaatgagcttaagatagaatgtccacatactattgggttgggtcaaggccttgttgtaggatcagtggaactgccacctgtcccaatacagcaggtggaaacattaaagctggaaagttcttgtaattttgatttgcatactagtacagcaggacaacaggcatttacaaagtggacatgggaaataaaaggtgatcttgcagaaaatacacaggcatcatcaacaagttttcaaacaaaaagtagtgaagtaaacttgagaggactatgtctgattccaactctagttattgagacagcagcaaggatgcggaaaacaatagcatgctatgatctatcatgtaaccaaacagtatgccaacctactgtgtatcttatgggacctatccaaacttgtataacaactaagagttgtcttttgggcctaggtgatcaaagaattcaagtgaattatgaaaagacatactgtgtttcagggcagttggttgagggtgtctgttttaatccaatacatacaatggctctctctcagcccagccatacctatgatatagttaccatgatggttcgttgttttctaattataaaaaaggtgacatctggtgatagcatgaagatcgaaaagaattttgagactcttgttcaaaaaaacgattgtacagctaatagtttccaaggttattacatctgtttcataggaagtagctcagagccattatatgtcccaacactggatgactaccgttctgctgaagtcctttcaagaatggcgtttgcacctcatggggaagatcatgatgttgaaaaaaatgcgataagtgccctacgtattgctgggaaagtaacagggaaagcaccatccactgagtcttctgacacagtacagggtattgcattttcaggtagccctctttatacatctactggggttttagcagcaaaggatgaccctgtgtatatttgggccccaggcattatcatggaagggaaccactctatctgtgagaaaaagaccttacctctcacatggactggttttatttcattacctggagaaattgagaagacaacacaatgcacagttttctgcaccctggctgggccaggtgcagactgtgaagcttattctgaaacaggtatatttaatataagctcaccgacttgcttgatcaatcgtgtgcagaggtttcgtggtgcagaacaacaaataaagtttgtttgtcagagggttgatatggatatcactgtgtattgcaatggagttaagaaagttattctcaccaaaaccttagttataggacagtgtatctacacatttactagtatattctctttaattccaggggttgcacactctcttgctgttgaactatgtgtgccaggtcttcatggctgggcaactatgttattattgctaacattttgttttggctgggttctaataccaaccattacaatgatattgctgaaaatattgattgcatttgcatatctttgctctaaatataacacagattcaaaatttaggattttgattgaaaaagtaaaaaaagaatatcagaaaacaatgggctcaatggtctgtgaggtatgtcaatatgagtgtgaaactgcaaaggagctagaatcacataggaaaagctgttcaattggctcgtgtccttattgtctcaacccatctgaggcaacaacatctgcccttcaggcccattttaaagtctgtaagctcacatcacgattccaggagaatttgagaaagtcattaactgtatatgagcctatgcagggttgttatcgtaccttatccctcttcaggtatcggagtcggttttttgttggcttagtctggtgtgtgctattagtcttagaattgattgtatgggctgctagtgctgagacacaaaatttgaatgcaggctggactgatacagcacatggatctgggataattcctatgaaaactgatcttgaattggacttctctctcccttcatctgcaagctatacatataggagacagttacaaaatccagctaatgaacaagaaaacataccattccatctgcagataagcaaacaggtaattcatgcagagatacagcatttagggcactggatggacgctacatttaatctaaaaactgcatttcattgctatggttcatgtgaaaaatatgcttatccttggcagactgctggttgttttgtagaaaaagattatgagtatgaaactggttggggctgtaatccacctgattgcccaggagtagggacagggtgtactgcctgtggggcctatcttgacaaattgaaatcagttgggaaagtctttaaaattgtgtccttaaggtataccaggaaagtgtgcattcagttaggtactgaacaaacttgtaagacagttgatagtaatgactgtttgataactacttcagtcaaagtgtgcttaataggaacaatttcaaaatttcaaccctctgatactctattattcttaggccctctccaacagggtggtttaatatttaagcaatggtgcactacaacatgccaatttggtgaccctggagatataatgagcacacctacaggaatgaaatgtccagatctaaatggttcctttagaaagaaatgcgcatttgcaacaacacctgtgtgccaatttgatgggaatacaatttcaggatacaaaaggatgattgctacaaaggattcatttcaatcattcaatgtcacagaaccccacatatctgcaagtgcattagaatggattgaccctgatagctcacttcgagatcatataaatgtaattgtaagtcgagatttatcttttcaagatttaagtgaaacaccatgccaaattgacctttcaacaacatccatagatggggcatggggttcaggagttggttttaacctggtctgtacagttagcttaacagaatgttctgcatttcttacttcaattaaggcatgtgatgctgcaatgtgttatggatctactacagctaatctaattaggggacaaaatactattcacatcgttgggaagggtgggcattctggctcaaaatttatgtgctgtcatgacactaagtgctctactactggtcttgttgcagctgcaccgcatttagaccgtgtaacagggtataatcaagcagacagtgataaaatctttgatgatggtgcaccagagtgcggtatgtcttgctggtttaaaaaatctggagaatggattcttggagtcctcaatggaaattggatggtggtggctgtattgatagcattgttagttttgtccatccttttgttcacattatgctgcccgcgtagaccaagttacagaaaagagcataaaccttag

SEQ ID NO: 3421 - RNA, 3447 nt, synthetic construct
  misc_feature 1..3447: note = derived and/or modified CDS sequence (wt) from PUUV(Sotkamo)__NC_005223.1__GP
  source 1..3447: mol_type = other RNA
atgggaaaatcgagtccagtttgtctgtatctgattcttcagggtctattactatttgatacagtaaatgccaaaaacctgaatgaacttaaaatggagtgtccgcacactattgggctaggtcaaggccttgttgtaggttcagtagaactaccacctgtcccaatacagcaaattgaatccttaaaattagagagttcttgtaattttgatttgcacaccagtacagcagggcaacagtcatttacaaaatggacatgggagacaaaaggtgatcttgcagaaaatacacaagcatcatcaacaagttttcagacaaaaagtagtgaggtcaatttaagaggtctgtgcttgatccctaccctagtggttgaaacagcagcaaggatgcggaagacaatagcatgttatgacttgtcatgtaatcaaacagtatgtcagcctactgtttatttaatgggacctattcaaacatgcttaacaaccaaaagttgtcttctgggtttaggagatcaacgaatccaggtaaattatgagagaacatactgtgtttcagggcagcttgttgaaggtgtctgcttcaacccaatacacacaatggccctctctcagccaagccatacttatgatatagtgaccataatggttcgctgttttttggtcataaaaaaggtgacatctggcgacagtatgaagattgaaaaaaactttgaaactcttgttcagaagactgggtgtacggccaatggttttcaaggatattacatctgtcttattgggagtagctcagagccattgtatgttcccacgctggatgattatcggtcagctgaggttctgtcacgaatggcttttgcaccacatggcgaagatcatgacatagaaaaaaatgcagtgagtgccttacgcattgctgggaaggttacaggtaaagcaccatccactgaatcatcagatacagtacaaggtattgcattttcaggcagcccactctatacatctactggtgtgctgacagcaaaggatgatcctgtatatgtctgggccccaggaattattatggagggaaaccactctgtctgtgaaaaaaagacactgccgttaacatggacagggttcatcccattacctggggagattgaaaagacaacacaatgcacggttttttgtactttagcaggaccaggtgcagactgtgaagcatattctgagacaggtattttcaatataagctcacctacttgcctgataaaccgtgttcaaagattccgtggtgctgaacagcaaataaaatttgtttgtcaaagagtagacatggatatcactgtatattgtaatggagtaaaaaaagtcatccttactaaaaccttagttattggacagtgcatttatacttttacaagtatcttttccatgattccaggaattgcacattctcttgctgttgagctatgtgtgccaggtcttcatggttgggctacagtattgcttttattaacattttgctttggctgggttctgataccaactattacaatgatcttgttaaaaatattaattgcatttgcatatctttgctctaagtataatactgattccaaatttagaattttggttgagaaagtaaaaaaggaatatcagaaaaccatgggctcaatggtttgtgaggtatgtcagtatgagtgtgaaactgctaaggagttagaatcacatagaaagagctgttcaattggttcatgcccttattgccttaatccatctgaggctacaccgtctgctcttcaagctcattttaaagtttgtaaactaacatcacggtttcaggaaaatttgaagaagtcactaacaatgtatgagccaatgcagggttgttatcgaacattatctctatttaggtaccgcagtagattttttgtaggtttagtgtggtgtatgttgcttgttttagagctaattgtatgggctgctagtgctgagacacaaaacttaaatgatggttggactgatactgcacatggatcaggaataatacctatgaaggctgatcttgaactggatttctcattaccttcatctgctagctatacttaccgaagacaattacaaaacccggcaaatgaacaagaaaaaataccatttcatttacagataagtaaacaggtgattcatgctgaaattcaacatctaggccactggatggatgctacatttaacttaaaaactgcttttcactgttatggttcatgtgaaaaatatgcctacccctggcaaacagcaggatgtttcgttgaaaaagattatgaatatgaaactggttggggttgtaatccccctgattgtcctggtgtagggacaggctgcactgcttgcggtgtatatctggataagttaaaatcagttggaaaggtatttaagattgtgtctttaagatatacaaggaaagtatgcattcagttgggtaccgggcaaacctgtaaaactgttgacagtaatgattgtttaataactacatcagttaaagtgtgcttgataggtaccatttcaaagttccaaccttctgataccctcttattcctcggtcctctccaacaaggtggtttaatttttaagcaatggtgtactactacatgtcaatttggtgatcccggagatataatgagtacacccacagggatgaagtgtccagaacttaatggttcattcagaaaaaaatgtgcatttgcaacaacacctgtatgtcagtttgatgggaatacaatttcaggttataaacggatggttgcaacaaaagattcatttcaatcatttaatgtaacagaaccacacatctctacaagtgcattggagtggattgacctagatagttcacttcgggatcacatcaatgtgattgtaagccgtgatttgtcctttcaggatttaagtgaaacaccttgtcaagtggatttgacaacatcagctacagatggggcatggggttcaggagttggttttaacctggtatgtactgttagtttaacagaatgctctgcatttttaacttcaattaaggcatgtcatgctgctatgtgttatggttctactacaacgaatttagttcgagggcagaatacaattcatgttgttggtaaaggtggacattctggttcaaagtttatgtgttgtcatgacacaaagtgctctagtacagggttagttgcagctgcaccacacttggatcgtgtgacagggtttaatcaagctgatagtgataagatctttgatgatggcgctccagagtgtggtatgtcttgctggtttaaaaaattaggagaatgggttcttggagtccttaatgggaattggatggttgtggctgtgttgatagcattacttatactatccatcttcttatttgcattatgttgtccacgcaggcccagttataagaaagatcataaaccttaa

SEQ ID NO: 3422 - RNA, 3447 nt, synthetic construct
  misc_feature 1..3447: note = derived and/or modified CDS sequence (wt) from PUUV(2009)__HE801634.1__GP
  source 1..3447: mol_type = other RNA
atgggaaaatcgagtccagtttgtctgtatctgattcttcagggtctattactatttgatacagtaaatgccagaaacctgaatgaacttaaaatggagtgtccgcacactattgggctaggtcaaggccttgttgtaggttcagtagaactaccacctgtcccaatacagcaaattgaatccttaaaattagagagttcttgtaattttgatttgcacaccagtacagcagggcaacagtcatttacaaaatggacatgggagacaaaaggtgatcttgcagaaaatacacaagcatcatcaacaagttttcagacaaaaagtagtgaggtcaatttaagaggtctgtgcttgatccctaccctagtggttgaaacagcagcaaggatgcggaagacaatagcatgttatgacttgtcatgtaatcaaacagtatgtcagcctactgtttatttaatgggacctattcaaacatgcttaacaaccaaaagttgtcttctgggtttaggagatcaacgaatccaggtaaattatgagagaacatactgtgtttcagggcagcttgttgaaggtgtctgcttcaacccaatacacacaatggccctctctcagccaagccatacttatgatatagtgaccataatggttcgctgttttttggtcataaaaaaggtgacatctggtgacagtatgaagattgaaaaaaactttgaaactcttgttcagaagactgggtgtacggccaatggttttcaaggatattacatctgtcttattgggagtagctcagagccattgtatgttcccacgctggatgattatcggtcagctgaggttctgtcacgaatggcttttgcaccacatggcgaagatcatgacatagaaaaaaatgcagtgagtgccttacgcattgctgggaaggttacaggtaaagcaccatccactgaatcatcagatacagtacaaggtattgcattttcaggcagcccactctatacatctactggtgtgctgacagcaaaggatgatcctgtatatgtctgggccccaggaattattatggagggaaaccactctgtctgtgaaaaaaagacactgccgttaacatggacagggttcatcccattacctggggagattgaaaagacaacacaatgcacggttttttgtactttagcaggaccaggtgcagactgtgaagcatattctgagacaggtattttcaatataagctcacctacttgcctgataaaccgtgttcaaagattccgtggtgctgaacagcaaataaaatttgtttgtcaaagagtagacatggatatcactgtatattgtaatggagtaaaaaaagtcatccttactaaaaccttagttattggacagtgcatttatacttttacaagtatcttttccttgattccaggaattgcacattctcttgctgttgagctatgtgtgccaggtcttcatggttgggctacagtattgcttttattaacattttgctttggctgggttctgataccaactattacaatgatcttgttaaaaatattaattgcatttgcatatctttgctctaagtataatactgattccaaatttaagattttggttgagaaagtaaaaaaggaatatcagaaaaccatgggctcaatggtttgtgaggtatgtcagtatgagtgtgaaactgctaaggagttagaatcacatagaaagagctgttcaattggttcatgcccttattgccttaatccatctgaggctacaccgtctgctcttcaagctcattttaaagtttgtaaactaacatcacggtttcaggaaaatttgaagaagtcactaacaatgtatgagccaatgcagggttgttatcgaacattatctctatttaggtaccgcagtagattttttgtaggtttagtgtggtgtatgttgcttgttttagagctaattgtatgggctgctagtgctgagacacaaaacttaaatgctggttggactgatactgcacatggatcaggaataatacctatgaaggctgatcttgaactggatttctcattaccttcatctgctagctatacttaccgaagacaattacaaaacccggcaaatgaacaagaaaaaataccatttcatttacagataagtaaacaggtgattcatgctgaaattcaacatctaggccactggatggatgctacatttaacttaaaaactgcttttcactgttatggttcatgtgaaaaatatgcctacccctggcaaacagcaggatgtttcgttgaaaaagattatgaatatgaaactggttggggttgtaatccccctgattgtcctggtgtagggacaggctgcactgcttgcggtgtatatctggataagttaaaatcagttggaaaggtatttaagattgtgtctttaagatatacaaggaaagtatgcattcagttgggtaccgagcaaacctgtaaaactgttgacagtaatgattgtttaataactacatcagttaaagtgtgcttgataggtaccatttcaaagttccaaccttctgataccctcttattcctcggtcctctccaacaaggtggtttaatttttaagcaatggtgtactactacatgtcaatttggtgatcccggagatataatgagtacacccacagggatgaagtgtccagaacttaatggttcattcagaaaaaaatgtgcatttgcaacaacacctgtatgtcagtttgatgggaatacaatttcaggttataaacggatggttgcaacaaaagattcatttcaatcatttaatgtaacagaaccacacatctctacaagtgcattggagtggattgacccagatagttcacttcgggatcacatcaatgtgattgtaagccgtgatttgtcctttcaggatttaagtgaaacaccttgtcaagtggatttgacaacatcagctatagatggggcatggggttcaggagttggttttaacctggtatgtactgttagtttaacagaatgctctgcatttttaacttcaattaaggcatgtgatgctgctatgtgttatggttctactacaacgaatttagttcgagggcagaatacaattcatgttgttggtaaaggtggacattctggttcaaagtttatgtgttgtcatgacacaaagtgctctagtacagggttagttgcagctgcaccacacttggatcgtgtgacagggtttaatcaagctgatagtgataagatctttgatgatggcgctccagagtgtggtatgtcttgctggtttaaaaaattaggagaatgggttcttggagtccttaatgggaattggatggttgtggctgtgttgatagcattacttatactatccatcttcttatttgcattatgttgtccacgcaggcccagttataagaaagaacataaaccttaa

SEQ ID NO: 3423 - RNA, 3447 nt, synthetic construct
  misc_feature 1..3447: note = derived and/or modified CDS sequence (wt) from PUUV(Umea/hu)__AY526218.1__GP
  source 1..3447: mol_type = other RNA
atgggaaaacttagtccagtttgtctgtatctgtttctgcagtgtctattactatggagtagaggaagtgccagaaacctaaatgaacttaaaatggaatgtccacacactattggtttgggtcaaggccttgtcattggttcagtggagttaccacctgttccagtacaacaagtagagtctttgaagttggagagttcctgtaattttgatttacacactagcacagcaacccagcaatcatttacaaaatggacatgggaaatgaaggatgatttagctgaaaacactcaagcatcgtcaacaagttttcaaacaaaaagtagtgaagtgaatttaagagggttgtgtttaattccccccttagtggttgaaacagcatcacggacccggaagacgattgcttgttttgacatttcatgtaaccaaacagtgtgtcagccgactgtttacttagtaggacctatacagacatgtattacaacaaaaagctgtcttttaggtttgggtgatcaaaggattcaagtcaattatgaaaaaacatactgtgtctcaggtcagctggttgaaggggtatgttttaatcctgtacacacaatggttctttcccaacctagccatacttatgatatagtgaccatgatggtacggtgttttctggtcgtaaagaaagtaacctcaggtgatagcatgaaaattgaaaagaaccttgagactttggtccagaaaactgattgcaatgcaaatggctttcagggctattatatttgtcttgtgggaagcagctcagaaccattatatgttcctacattagatgattatcggtctgctgaagttttatcaagaatggcttttgcaccacatggagaagatcatgatattgagcgaaatgctgtgagtgctttaagaattgtaggtaaagtaaccggcaaagcaccgtcaactgaagcatctgacacgatacagggtatagccttttcaggcagccccctttatacatctacaggggtattaacagcaaaggataacccggtttatgtttggtcaccagggattatcatggaagggaatcattctgtatgtgaaaaaaagacattaccccttacctggactggattcataccattacctggggagattgggaaaacatcgcagtgcacagtcttctgcactttggcagggccaggtgctgattgtgaagcttactctgaaactggaatttttaatataagctcacccacttgtttgatcaatcgtgcacagagatttcgtggtgcagagcaacagataaaatttgtctgccagagagttgacatggacatcactgtatattgtaatggaatgaagaaagtgattctcaccaaaactctagttataggacaatgcatatatactttcactagtattttctcactaattcctgggattgcacattcacttgccgtagaattatgtgttccaggccttcatggctgggctacagtattacttttactaactttttgttttggctggatccttattccatttattgctatgatatcactgaaaatattaattgcatttgcatatttgtgttcaaaatacaacacagactccaagtttaaaattctgattgagaaagtaaagaaggaatatcaaaagacaatgggctcaatggtatgtgaggtctgtcaatatgaatgtgaaacagcaaaagaattagaatctcatcggaaaagctgtccaattggctcctgcccatattgtcttaatccatctgaggcaacaacatcagcccttcaggctcatttcaaagtgtgtaaactgacatcaagggttcaggataatttaaggaagtcattggcagcttacgagcccaagcaaggatgttatcgaacattatccctttttcgttaccggagccgtttctttgtaggctttatctggtgcatattactggttttagaattgatcatttgggctgccagtgcagaaacacaaaatctaaactcaggatggacagatactgcacatggttcaggtattattcccatgagaactgacttggaattggatttctcactaccatcatctgcaagttacacatacagaagacagttacagaatcctgcaaatgaacatgaaaaaataccatttcatttacaaataagcaaacaagtaatacatgctgagattcagcatttaggtcattggatggatgctacttttaacttaaagacagcatttcattgttatggctcatgtgaaaagtatgcctatccttggcaaacagctggttgtttttttgaaaaggactatgagtttgaaagtagttggggatgtaatcccccagattgcccaggtgttggaacaggttgtactgcatgtggtgtatatcttgacaaacttaaatcagtagggaaggtttttaagatcatttcattaaggtatacaaggaaagcatgtattcagcttggcactgaacagacttgtaaaagtgttgacagcaatgattgtctggtcactacttcagttaaggtatgcctgattggaactgtttcaaaatttcaaccctcagatacattattattcttaggcccacttgagcaaggtggattaatattcaaacaatggtgtacaacaacatgtcaatttggtgatcctggggatataatgagtactccaacagggatgaaatgtccagagcttaatgggtcatttagaaaaaaatgtgcatttgcaacaacaccagtatgccaatttgatggaaatacaatatctggatacaagcggatgattgcaactaaagattctttccagtcatttaatgttacagaccctcatatttctacaagtgcacttgaatggatcgatccagatagttctcttagagatcatattaatgttgttgtgagtcgtgatctttctttccaggatttgagtgaaacaccatgtcaagtagatttgaccacatcttctatagatggagcatggggttcaggtgtcggctttaatttagtctgtacagtcagtttgacagaatgctcaacttttttaacttccattaaagcatgtgattctgcaatgtgttatggctctaccacaatcaacctaatgagagggcagaatacagtccatattgttggaaaaggaggtcattctggttcaaaatttatgtgttgtcatgatacaaagtgctctagtacaggcctggttgcagctgcaccacatttagaccgggtaacagggtttaatcaagccgacagtgacaagatttttgatgatggtgcaccagaatgtggcatgtcttgttggtttaaaaaatcaggtgaatggattcttggtgtattaaacgggaattggttagttgtggctgtactagtagcattattcatattatccatattcttgtttaccttatgctgcccccgaagacccatctatgctaaagagcataagccttaa

SEQ ID NO: 3424 - RNA, 3447 nt, synthetic construct
  misc_feature 1..3447: note = derived and/or modified CDS sequence (wt) from PUUV(P360)__L08755.1__GP
  source 1..3447: mol_type = other RNA
atgggagaacttagtccagtttgtctgtgtctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcttgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgcttaataaatcgtgtccaaagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacattttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 3425 - RNA, 3447 nt, synthetic construct
  misc_feature 1..3447: note = derived and/or modified CDS sequence (wt) from MUV(11-1)__JX028272.1__GP
  source 1..3447: mol_type = other RNA
atgggaaaaataagtccagtttatctgtatctgctttttcagggcctactactatggagggacggattagccagaaatcttaatgagctgaaaatggagtgtccacatacaatcggattagggcaaggacttgtaattggctcagttgaactcccaccagtgccattacgtcaagtggagtcactaaagcttgagagctcctgtaactttgacctgcacacaagtactgcaacacagcagtcatttacaaagtggatatgggagtcaaaaaatgatttaactgatagcacacaggcatcttccactagttatcagaccaagagtacagaggtaaatctcaaaggcttatgtcttgtcccaacacttgtaatcgagactgcagcaaggactagaaagacaattgcctgttttgatctatcatgtaatcaaactgtctgtcagccaacagtgtatctgattgggcctatacagacatgtattaccaccaaaagttgcttaattggattaggggatcaaagaattcaggtaaactatgaaaagacttattgtgtatcaggtcagcttgtagaaggggtatgctttaatccaatacataccatggcattatcacagccaagtcacacctatgatgtagtcacaatgatggtcaggtgtttcttggtagtgaagaaagtgacctctggtgacagcatgaagattgaaaaaaactttgaaacccttgttcagaaaacaggctgctctaataataattttcaaggctattatgtgtgtcttattgggagtagctctgagccattgtatgtccctacactagatgattacaggtctgctgaaatcctttctagaatggcatttgccccacatggcgaggatcatgacattgagaggaatgcaatcagtgcaatgagaattgtagggaaagttactgggaaagcaccttcttctgagtcatcagatacagtacaaggagtagcattttcagggaaccctttatacacatcaaccggagtactgacatctaaagatgatcctgtgtatgtatgggcccctggtattatcatggaagggaatcattctgtgtgtgataaaaagacactgccgctaacatggactggttatataccactaccaggtgagattgaaaaaacaacacaatgtactgttttttgtactttggctgggcctggcgccgattgtgaagcatactcagaaacaggtatcttcaacataagttcccctacttgcctgatcaatagggtacaaaggttccgaggggcagaacagcagattaagtttgtgtgtcagagggtggacatggatatcactgtttattgcaatggaattaaaaaagtaatccttacaaagactttagttataggacaatgcatttatacctttactagtatcttttcattaatgccaggagttgctcactccttagctgttgaactatgtgttcctggcctgcacggttgggcaaccatgctattactgcttacattttgctttggctggatccttatacctacaatcacattgattctccttaaaatattgttggcttttgcatatgtatgctcaaaatacaatacagactctaagtttaaaatcctcatagagaaagtgaagcaggaataccaaaagacaatgggttccatggtttgtgaagtttgccagcatgaatgtgaaactgcaaaagaactagaatcacacaagaaaagctgtccgattggttcttgtccttattgcctaaaccctgctgaagctaccacgtctgcccttcaagcacacttcaaggtgtgtaaattaacatctaggtttcaggaaaatttacggaagtcattaactgtctatgaacctaagcagggctgctataggacattgtcccttttccgttataggagcaggtgttttgtagggctgatctggtgtatcctcttaacactggaactaatcgtgtgggctgcaagtgctgaaacactaaatttaaatccaggatggacagatactgcccatggctctggaatagttccaatgaaaactgacttggaattagatttttctttaccatcttcagcaagttatacttaccgccgctccttacaaaacccagcaaatgaacaagagcaagtaccattccatctacagattgagaaacaggtaatccatgctgaaattcaacatttaggtcactggatggatgcaacctttaatttaaagactgctttccattgttatggtgcatgtgagaagtatgcatacccatggcagacagctggttgttttgtggaaaaagattttgaatttgaaaatggatggggttgtaaccctcctgactgtcctggtgtcggtacaggctgtacagcatgcggggcttacttagataaattgaaatcagtcggaaaagtatttaaaattgtgtcacttcgttacacaaggaaagcatgcatacagttaggtaccgaacaaacatgtaaaaatgtagacagcaatgattgtttggtcactacatctgttaaagtatgccttatagggacaatatcaaagtttcaaccctctgacacacttctcttcttaggtcctttagaacaaggtgggataatctttaaacaatggtgcacaactacatgtcagtttggagatcctggagatattatgagcacaccgattggtatgaagtgccctgaactgaatggatcttttaggaaaaaatgttcatttgcaacaacacctgtttgccagtttgatggaaatactatttcaggatataagcggatgatagccacaaaagattcatttcaatcattcaatgttacagaaccacatatttctgccagtgcgcttgaatggatagacccagatagttcattgagagaccatattaacgtagttgttgggagagacctcccgtttcaagatctgagtgaaaccccatgtcaaattgacttgtccacatcttcaattgacggggcttggggttctggggtgggattcaaccttgtttgttcagtaagcctaacagagtgttttacatttttgaattcgataaaggcatgtgacactgccatgtgttacggatcaaccacagctaacctagtccgggggcaaaatacagtccatgtggtaggtaagggtggacactcaggctccaagttcatgtgctgtcacgatacaaagtgctcaaacactggcttactggcagcagcaccacatttggacagagtaacaggatataatcaggcagatagtgataaggtctttgatgatggagcaccagagtgtggtatgacctgttggtttaaaaaatctggtgaatggatcatgggtgttctcagtggaaattggatggttgtggctgtattgatcacattgcttgtattgtctatttttctgtttgccctatgctgccccagacgtgctgcatataagaaggagcataagccctaa

SEQ ID NO: 3426 - RNA, 3447 nt, synthetic construct
  misc_feature 1..3447: note = derived and/or modified CDS sequence (wt) from MUV(11-4)__JX046483.1__GP
  source 1..3447: mol_type = other RNA
atgggaaaaataagtccagtttatctgtgtctgcttcttcagggcctactactatggagggacggattagccagaaatcttaatgagctgaagatggagtgtccacatacaatcggattagggcaaggacttgtaattggctcagttgaactcccaccagtgccgttacgtcaagtggagtcactaaagcttgagagctcctgtaactttgacttgcacacaagtactgcaacacagcagtcatttacaaagtggatatgggagtcaaaaaatgatttaactgatagcacacaggcatcttctactagttatcagaccaagagcacagaggtaaatctcaaaggcttatgtcttgtcccaacacttgtaatcgagactgcagcaaggactagaaagacaattgcctgttttgatctatcatgtaatcaaactgtctgtcagccaacagtgtatctaattgggcctatacagacatgtattaccactaaaagttgcttaattggattaggggatcaaagaattcaggtaaactatgaaaagacttattgtgtgtcaggtcagcttgtagaaggggtatgctttaatccaatacataccatggcattatcacagccaagtcacacctacgatgtagtcacaatgatggtcaggtgtttcttggttgtgaagaaagtaacctctggtgacagcatgaagattgaaaaaaactttgaaacccttgttcagaaaacaggctgctctaataataattttcaaggctattatgtgtgtcttattgggagtagctctgagccattgtatgtccctacactagatgattacaggtctgctgaaatcctttctagaatggcgtttgccccgcatggcgaggatcatgacattgagaggaatgcaatcagtgcaatgagaattgtagggaaagttactgggaaagcaccttcttctgagtcatcagatacagtacaaggaatagcattttcaggaaaccctttatacacatcaaccggagtactgacatccaaagatgatcctgtgtatgtatgggcccctggtattatcatggaagggaatcattctgtgtgtgataaaaagacactgccactaacatggactggttatataccgctaccaggtgagattgaaaaaacaacacaatgtactgttttttgtactttggctgggcctggcgccgattgtgaagcatactcagaaacaggtatctttaacataagttcccctacttgtctgatcaatagggtacaaaggttccgaggggcagaacagcagattaagtttgtgtgtcagagggtggacatggatatcactgtttattgcaatggaattaaaaaagtaatccttacaaagactttagttataggacaatgcatttatacctttactagtatcttttcattaatgccaggagttgctcactccttagctgttgaactatgtgttcctggcctgcacggttgggcaaccatgctattactgcttacattttgttttggctggatccttatacctacaatcacattgattctccttaaaatattgttggctttcgcatatgtatgctcaaaatacaatacagactctaagtttaaaattctcatagagaaagtgaagcaggaataccaaaagacaatgggttccatggtttgtgaagtttgccagcatgaatgtgaaactgcaaaagaactagaatcacacaagaaaagctgtccgattggttcttgtccttattgcctaaaccctgctgaagctaccacgtctgcccttcaagcacacttcaaggtgtgcaaattgacatctaggtttcaggaaaatttacggaagtcattaactgtctatgaacctaagcagggctgctataggacattgtcccttttccgttataggagcaggtgttttgtaggactgatctggtgtatcctcttaacactggaactaatcgtgtgggctgcaagtgctgaaacactaaatttaaatccaggatggacagatactgcccatggctctggaatagttccaatgagaactgacttagaattagatttttctttaccatcttcagccagttatacttatcgccgctccttacaaaacccagcaaatgaacaagagcaaataccattccatctacagattgaaaaacaggtaatccatgctgaaattcaacatttaggtcactggatggatgcaacctttaatttaaagactgctttccattgttatggtgcatgtgagaagtatgcatacccatggcagacagctggttgttttgtagaaaaagattttgaatttgaaaatggatggggttgtaaccctcctgactgtcctggtgtcggtacaggctgtacagcatgtggggcttacttagataagctgaaatcagtcgggaaagtgtttaaaattgtgtcacttcgttatacaaggaaagcatgcatacagttaggtaccgaacaaacatgtaaaaatgtagacagcaatgattgtttggtcactacatctgttaaagtatgccttatagggacaatatcaaagtttcaaccctctgacacacttctcttcttaggtcctttagaacaaggtgggataatctttaaacaatggtgtacaactacatgtcagtttggagatcctggagatattatgagcacaccgattggtatgaagtgccctgaactgaatggatcttttaggaaaaaatgttcatttgcaacaacacctgtttgccagtttgatggaaatactatttcaggatataagcggatgatagccacaaaagattcatttcaatcattcaatgttactgaaccacatatttctgccagtgcgcttgaatggatagacccagatagttcattaagggaccatattaacgtagttgttgggagagacctcccgtttcaagatctgagtgaaaccccatgtcaaattgacctgtccacatcttcaattgacggggcttggggttctggagtgggattcaaccttgtttgttcagtaagcctgacagagtgttctacatttttgacttcaattaaggcatgtgacactgccatgtgttacggatcaaccacagctaacctagtccgggggcagaatacagtccatgtagtaggtaagggtggacactcaggctctaagttcgtgtgctgtcacgatacaaagtgctcaaacactggcttactggcagcagcaccacatttggatagagtaacagggtataatcaggcagatagtgataaggtctttgatgatggagcaccagagtgtggtatgacctgttggtttaaaaaatctggtgaatggatcatgggtgttctcagtggaaattggatggttgtggctgtattgatcacattgcttgtattgtctatttttctgtttgccctatgctgccccagacgtgctgcatataagaaggagcataaaccttaa

SEQ ID NO: 3427 - RNA, 3447 nt, synthetic construct
  misc_feature 1..3447: note = derived and/or modified CDS sequence (wt) from MUV(11-5)__JX046486.1__GP
  source 1..3447: mol_type = other RNA
atgggaaaaataagtccagtttatctgtgtctgcttcttcagggcctactactatggagggacggattagccagaaatcttaatgagctgaagatggagtgtccacatacaatcggattagggcaaggacttgtaattggctcagttgaactcccaccagtgccgttacgtcaagtggagtcactaaagcttgagagctcctgtaactttgacttgcacacaagtactgcaacacagcagtcatttacaaagtggatatgggagtcaaaaaatgatttaactgatagcacacaggcatcttctactagttatcagaccaagagcacagaggtaaatctcaaaggcttatgtcttgtcccaacacttgtaatcgagactgcagcaaggactagaaagacaattgcctgttttgatctatcatgtaatcaaactgtctgtcagccaacagtgtatctaattgggcctatacagacatgtattaccactaaaagttgcttaattggattaggggatcaaagaattcaggtaaactatgaaaagacttattgtgtgtcaggtcagcttgtagaaggggtatgctttaatccaatacataccatggcattatcacagccaagtcacacctacgatgtagtcacaatgatggtcaggtgtttcttggttgtgaagaaagtaacctctggtgacagcatgaagattgaaaaaaactttgaaacccttgttcagaaaacaggctgctctaataataattttcaaggctattatgtgtgtcttattgggagtagctctgagccattgtatgtccctacactagatgattacaggtctgctgaaatcctttctagaatggcgtttgccccgcatggcgaggatcatgacattgagaggaatgcaatcagtgcaatgagaattgtagggaaagttactgggaaagcaccttcttctgagtcatcagatacagtacaaggaatagcattttcagggaaccctttatacacatcaaccggagtactgacatccaaagatgatcctgtgtatgtatgggcccctggtattatcatggaagggaatcattctgtgtgtgataaaaagacactgccactaacatggactggttatataccgctaccaggtgagattgaaaaaacaacacaatgtactgttttttgtactttggctgggcctggcgccgattgtgaagcatactcagaaacaggtatctttaacataagttcccctacttgtctgatcaatagggtacaaaggttccgaggggcagaacagcagattaagtttgtgtgtcagagggtggacatggatatcactgtttattgcaatggaattaaaaaagtaatccttacaaagactttagttataggacaatgcatttatacctttactagtatcttttcattaatgccaggagttgctcactccttagctgttgaactatgtgttcctggcctgcacggttgggcaaccatgctattactgcttacattttgttttggctggatccttatacctacaatcacattgattctccttaaaatattgttggctttcgcatatgtatgctcaaaatacaatacagactctaagtttaaaattctcatagagaaagtgaagcaggaataccaaaagacaatgggttccatggtttgtgaagtttgccagcatgaatgtgaaactgcaaaagaactagaatcacacaagaaaagctgtccgattggttcttgtccttattgcctaaaccctgctgaagctaccacgtctgcccttcaagcacacttcaaggtgtgcaaattgacatctaggtttcaggaaaatttacggaagtcattaactgtctatgaacctaagcagggctgctataggacattgtcccttttccgttataggagcaggtgttttgtaggactgatctggtgtatcctcttaacactggaactagtcgtgtgggctgcaagtgctgaaacactaaatttaaatccaggatggacagatactgcccatggctctggaatagttccaatgagaactgacttagaattagatttttctttaccatcttcagccagttatacttatcgccgctccttacaaaacccagcaaatgaacaagaacaaataccattccatctacagattgaaaaacaggtaatccatgctgaaattcaacatttaggtcactggatggatgcaacctttaatttaaagactgctttccattgttatggtgcatgtgagaagtatgcatacccatggcagacggctggttgttttgtagaaaaagattttgaatttgaaaatggatggggttgtaaccctcctgactgtcctggtgtcggtacaggctgtacagcatgtggggcttacttagataagctgaaatcagtcggaaaagtgtttaaaattgtgtcacttcgttatacaaggaaagcatgcatacagttaggtaccgaacaaacatgtaaaaatgtagacagcaatgattgtttggtcactacatctgttaaagtatgccttatagggacaatatcaaagtttcaaccctctgacacacttctcttcttaggtcctttagaacaaggtgggataatctttaaacaatggtgcacaactacatgtcagtttggagatcctggagatattatgagcacaccgattggtatgaagtgccctgaactgaatggatcttttaggaaaaaatgttcatttgcaacaacacctgtttgccagtttgatggaaatactatttcaggatataagcggatgatagccacaaaagattcatttcaatcattcaatgttactgaaccacatatttctgccagtgcgcttgaatggatagacccagatagttcattaagggaccatatcaacgtagttgttgggagagacctcccgtttcaagatctgagtgaaaccccatgtcaaattgacctgtccacatcttcaattgacggggcttggggttctggagtgggattcaaccttgtttgttcagtaagcctgacagagtgttctacatttttgacttcaattaaggcatgtgacactgccatgtgttacggatcaaccacagctaacctagtccgggggcagaatacagtccatgtagtaggtaagggtggacactcaggctctaagttcgtgtgctgtcacgatacaaagtgctcaaacactggcttactggcagcagcaccacatttggatagagtaacagggtataatcaggcagatagtgataaggtctttgatgatggagcaccagagtgtggtatgacctgttggtttaaaaaatctggtgaatggatcatgggtgttctcagtggaaattggatggttgtggctgtattgatcacattacttgtattgtctatttttctgtttgccctatgctgccccagacgtgctgcatataagaaggagcataaaccttaa

SEQ ID NO: 3428 - RNA, 3408 nt, synthetic construct
  misc_feature 1..3408: note = derived and/or modified CDS sequence (wt) from SANGV(SA14)__NC_034516.1__GP
  source 1..3408: mol_type = other RNA
atgatcatgtggggtttactacttctagcagccataaccttcccttgtcagtcattgaaaaatgtgtatgacatgaagattgaatgccctcattcagtcaattttggtgagagcagtgtgatgggaaaagtccagctgccatcactctcaatcactgaggcagagcaactcgtaccggaaagctcgtgtaacatggataaccatcagtctctttcagtgctccaaaaggcaacaaaaacaacttggagaaagaaagcagatcactcaaatgcaggaaaagattcgtatgagctaataacatcagaaattcaatttaaaggtgtctgctcgctcacacataagatgattgaggaatctcacaggttaagacgttcagttatctgttatgacttatcctgcaatactacacactgtaagccaacactatatatggttgtccctgttcactcctgtaatatgatgaaaagttgtctaataggacttggtccatatagaatccaggtagtttatgaaagaacatattgcactgtgggtgtcttgaatgaagggaaatgttttgtacctgatcagagtgtagccaatattgtaaaaaatggtatttttgacatcgtgagtgttcaaattatatgtttttttataagaattaaggggtcaacctacaagatattagaaacagttaagactgcaatgaatggcaagtgcaatgggacagatgataaagtacaaggctattatatctgcttgctaggtgggaattcaggtcctatatatgtaccatcaggaactgactttagggccatggaggctctagccaatatgctaagggctccacatggagaagaccatgacctacctggagaggagcttgcatcttactcaattgcaggcacaattgaaggaaagatccctcatacagcaagttcacaaaacttagaattcactgcgtattcaggtataccaagttattcatcattcagtgtccacacgttgacccaggatggacagctgagctacagccctggtttatttcccaacctgaatcaatctgattgtaaaaagaatgcattacctttaatatgggaaggcacaatagaactaccgggttattatgaagcaatacacccttgcaatgtcttttgtgtcttttcaggccctggtgcatcatgtgaggcattctcagaaggagggattttcaatatcacatcaccaacatgccttgtttctaaacaaaatagatttcgagctgctgaacaacaaataacatttgtatgccaacgggttgacatggatattatcatttactgcaatggacaaagaaaggtgattcttacgaaaactcttgttatcggtcagtgcatttattctattacaagtctattttctttattgccatctgtggcccattcgattgcaattgaattgtgtgtcccgggttttcatgggtgggcaactgcagccttgcttacaactttttgttttggttggttgttaataccttcaataacctatattgtactccttatcttgaaatttattgcagcaatcttccataacaccacccaagaaaataagtttaaagctatactaagaaaaataaaggaagagtttgaaaaaactaaaggttccatggtttgtgacatctgtaaatatgagtgcgagactgggaaagaattaaaagcacacaatctttcatgtaatcaatctcaatgcccttactgttttacccattgtgagatgacagagagtgcattccaagctcattataaagtctgtcaggctactcacaggtttcgagaagacttgaagaaaactataaccccccaaactatcagccctggctgttataggactttaaatctattccgatataagagcagatgctatatcctaacagtttggttgtgcttgttgattctggagtctattgcatgggcagctagtgcctctgagacttcattgaaccctctctggactgacaatgctcatggagtaggtagcgttccaatgcatacagatctggaacttgatttctcattaccatcaagctcaaaatacacatataaaaggaaattgactagtcccactaatcctgaacaagctgtttcactccatattgagattgaaagtcaaggaattgcagccgatgtccactcactaggccactggtatgatgctaggttaaatttgaagacatcttttcattgttatggtgcatgcacaaaataccagtacccttggcatactgccaagtgccactttgaacatgatttccagtatgaaaatagttggggctgcaatcctcccgactgccctggtgttgggacaggctgtactgcctgtggtctctatttagatcagttgaaacctgttggtagtgcttataaattaataacagtccggtatagccggaaggtgtgtgtgcaatttggagaggaaaacttgtgtaagaccattgacatgaatgattgcttcatgtctaggcatgtaaaggtttgcataatagggactgtttctaaattctcacaaggggacacactggtgtttctagggccactggaaggcgggggacttatctttaaggattggtgcacgtctacctgccaatatggtgatccaggagatatcatgagtcctagagacagaggttttagttgtcctgagtttcctggtagttttagaaaaaaatgcaattttgcaacaacaccggtgtgtgagtactcaggtaatatggtatctggttataaaaaagtcatggccacaattgactcatttcaatcatttaatacaagtttaattcactttacagaagagaggattgaatggaaggatcctgacgggatgcttagggaccacctgaacatactagtaacaaaggacatcgactttgaaaatcttggggaaaacccttgtaaagtagggcttcaaacatcatctattgagggtgcttggggctctggggttggatttacactggtatgtcaggtatctcttattgattgtgcacgatttttaacctccatcaaggcatgtgacatggctatctgctatggtgcacagagcgtatctttagttcggggtcaaaatacagtcaaaatcacaggtaagggtgggcacagtggttcttcctttaaatgttgtcatgaagtagactgctcgagtacaggtctgcaagcaagtgcaccacacctggacaaagtaaacgggatttcggagcaagaaaatgacaaggtttatgatgatggtgcaccacaatgtggggtaagttgttggtttgtgaagtccggagagtggattagtggaatcctacatggtaactgggttgtggttgttgtgcttgttattctactgttattttcacttatacttttgagtatcctttgtcctgtaagaaaacataagaggtcttaa

SEQ ID NO: 3429 - RNA, 3408 nt, synthetic construct
  misc_feature 1..3408: note = derived and/or modified CDS sequence (wt) from SANGV(SA14)__NC_034516.1__GP
  source 1..3408: mol_type = other RNA
atgatcatgtggggtttactacttctagcagccataaccttcccttgtcagtcattgaaaaatgtgtatgacatgaagattgaatgccctcattcagtcaattttggtgagagcagtgtgatgggaaaagtccagctgccatcactctcaatcactgaggcagagcaactcgtaccggaaagctcgtgtaacatggataaccatcagtctctttcagtgctccaaaaggcaacaaaaacaacttggagaaagaaagcagatcactcaaatgcaggaaaagattcgtatgagctaataacatcagaaattcaatttaaaggtgtctgctcgctcacacataagatgattgaggaatctcacaggttaagacgttcagttatctgttatgacttatcctgcaatactacacactgtaagccaacactatatatggttgtccctgttcactcctgtaatatgatgaaaagttgtctaataggacttggtccatatagaatccaggtagtttatgaaagaacatattgcactgtgggtgtcttgaatgaagggaaatgttttgtacctgatcagagtgtagccaatattgtaaaaaatggtatttttgacatcgtgagtgttcaaattatatgtttttttataagaattaaggggtcaacctacaagatattagaaacagttaagactgcaatgaatggcaagtgcaatgggacagatgataaagtacaaggctattatatctgcttgctaggtgggaattcaggtcctatatatgtaccatcaggaactgactttagggccatggaggctctagccaatatgctaagggctccacatggagaagaccatgacctacctggagaggagcttgcatcttactcaattgcaggcacaattgaaggaaagatccctcatacagcaagttcacaaaacttagaattcactgcgtattcaggtataccaagttattcatcattcagtgtccacacgttgacccaggatggacagctgagctacagccctggtttatttcccaacctgaatcaatctgattgtaaaaagaatgcattacctttaatatgggaaggcacaatagaactaccgggttattatgaagcaatacacccttgcaatgtcttttgtgtcttttcaggccctggtgcatcatgtgaggcattctcagaaggagggattttcaatatcacatcaccaacatgccttgtttctaaacaaaatagatttcgagctgctgaacaacaaataacatttgtatgccaacgggttgacatggatattatcatttactgcaatggacaaagaaaggtgattcttacgaaaactcttgttatcggtcagtgcatttattctattacaagtctattttctttattgccatctgtggcccattcgattgcaattgaattgtgtgtccctggttttcatgggtgggcaactgcagccttgcttacaactttttgttttggttggttgttaataccttcaataacctatattgtactccttatcttgaaatttattgcagcaatcttccataacaccacccaagaaaataagtttaaagctatactaagaaaaataaaggaagagtttgaaaaaactaaaggttccatggtttgtgacatctgtaaatatgagtgcgagactgggaaagaattaaaagcacacaatctttcatgtaatcaatctcaatgcccttactgttttacccattgtgagatgacagagagtgcattccaagctcattataaagtctgtcaggctactcacaggtttcgagaagacttgaagaaaactataaccccccaaactatcagccctggctgttataggactttaaatctattccgatataagagcagatgctatatcctaacagtttggttgtgcttgttgattctggagtctattgcatgggcagctagtgcctctgagacttcattgaaccctctctggactgacaatgctcatggagtaggtagcgttccaatgcatacagatctggaacttgatttctcattaccatcaagctcaaaatacacatataaaaggaaattgactagtcccactaatcctgaacaagctgtttcactccatattgagattgaaagtcaaggaattgcagccgatgtccactcactaggccactggtatgatgctaggttaaatttgaagacatcttttcattgttatggtgcatgcacaaaataccagtacccttggcatactgccaagtgccactttgaacatgatttccagtatgaaaatagttggggctgcaatcctcccgactgccctggtgttgggacaggctgtactgcctgtggtctctatttagatcagttgaaacctgttggtagtgcttataaattaataacagtccggtatagccggaaggtgtgtgtgcaatttggagaggaaaacttgtgtaagaccattgacatgaatgattgcttcatgtctaggcatgtaaaggtttgcataatagggactgtttctaaattctcacaaggggacacactggtgtttctagggccactggaaggcgggggacttatctttaaggattggtgcacgtctacctgccaatatggtgatccaggagatatcatgagtcctagagacagaggttttagttgtcctgagtttcctggtagttttagaaaaaaatgcaattttgcaacaacaccggtgtgtgagtactcaggtaatatggtatctggttataaaaaagtcatggccacaattgactcatttcaatcatttaatacaagtttaattcactttacagaagagaggattgaatggaaggatcctgacgggatgcttagggaccacctgaacatactagtaacaaaggacatcgactttgaaaatcttggggaaaacccttgtaaagtagggcttcaaacatcatctattgagggtgcttggggctctggggttggatttacactggtatgtcaggtatctcttattgattgtgcacgatttttaacctccatcaaggcatgtgacatggctatctgctatggtgcacagagcgtatctttagttcggggtcaaaatacagtcaaaatcacaggtaagggtgggcacagtggttcttcctttaaatgttgtcatgaagtagactgctcgagtacaggtctgcaagcaagtgcaccacacctggacaaagtaaacgggatttcggagcaagaaaatgacaaggtttatgatgatggtgcaccacaatgtggggtaagttgttggtttgtgaagtccggagagtggattagtggaatcctacatggtaactgggttgtggttgttgtgcttgttattctactgttattttcacttatacttttgagtatcctttgtcctgtaagaaaacataagaggtcttaa

SEQ ID NO: 3430 - RNA, 3402 nt, synthetic construct
  misc_feature 1..3402: note = derived and/or modified CDS sequence (wt) from SEOV(L99)__AF288298.1__GP
  source 1..3402: mol_type = other RNA
atgtggagtttgctattactggccgctttagttggccaaggctttgcattaaaaaatgtttttgacatgagaattcagtgtccccactcagtcaactttggggaaacaagtgtgtcaggctatacagaattgcccccactctcattacaggaggcagaacagctagtgccagagagctcatgcaacatggacaaccaccaatcactctcaacaataaataaattaaccaaggtcgtatggcgaaaaaaagcaaatcaggaattagcaaaccagaattcatttgaagttgtggagagtgaagtcagctttaaagggttatgtatgttaaagcatagaatggttgaagaatcatatagaaacagaagatctgtaatctgttatgatctagcctgtaatagtacattctgtaagccaactgtttacatgattgttcctatacatgcttgcaacatgatgaaaagttgtttgattggccttggtccctacagaattcaggttgtctatgaaaggacatactgcactacgggtatattgacagaaggaaaatgttttgtccccgacaaggctgttgtcagtgcattgaagagaggcatgtatgccatagcaagcatagagacaatctgcttttttattcataagaaagggaatacatataaaatagtgactgccatcacatcagcaatgggctccaagtgcaataatacagatactaaggtccaaggatattatatctgtattattggtggaaactctgctcctgtatatgcccccgctggtgaagactttagggcaatggaggttttttctgggattattacgtcaccgcatggagaagaccatgacctccctggcgaagaaatcgcaacataccagatttcagggcagatagaggcaaaaatccctcatacagtgagctctaaaagcttgaaattgattgcctttgcaggtattccatcatactcatcaactagtatattggctgcttcagaagacggtcgtttcatatttagtcctggtttatttcctaatttaaatcaatcagtctgtgacaacaatgcactccctttaatctggaggggcctaattgacttaacgggatactatgaggcagtccacccttgcaatgtattctgtgtcttatcaggaccaggtgcttcatgtgaagccttttcagagggaggtattttcaacattacttctccaatgtgtctggtgtccaagcaaaataggtttagagcagctgagcagcaaatcagctttatttgccaaagggttgatatggatattatagtgtactgtaatggtcaaaaaaagacaatattaacaaaaacattagttataggccagtgcatttatactattacaagtctcttttcactgttaccaggggttgcccattctattgctattgagttgtgtgttccaggttttcatggctgggccacagctgcacttttgatcacattttgctttggctgggtattgattcctgcatgcacattagctattcttttagtcctaaagttttttgcaaatatccttcatacaagcaatcaagagaaccgattcaaagccattctacggaaaatcaaggaggagtttgaaaaaacaaagggttccatggtttgtgagatctgtaagtacgagtgtgaaacattaaaggaattaaaggcacataatttatcatgtgtgcaaggggagtgcccatattgctttacgcactgtgaaccgacagaaactgcaattcaggcacattacaaagtttgtcaagccacccaccgattcagagaagatttaaaaaagactgtaactcctaaaaatattgggccaggctgttaccgaacattaaatctttttaggtataaaagtaggtgttatattctaacaatgtggactcttcttctcattattgaatctatcctctgggcggcaagtgcagcagaaatccctcttgtccctctctggacagataatgctcatggcgttgggagcgttcctatgcatacggatcttgaattagacttttctttgccatctagctctaagtacgcatataaaaggcatctcacaaacccagttaatgaccaacagagtgtctcattgcatatagaaattgaaagtcaaggcattggtgctgatgtccaccatcttggacattggtatgatgcaaggttaaatctgaaaacctcattccattgttatggtgcctgcacaaaataccaatatccatggcacactgcaaaatgccattttgagaaagattatgagtatgaaaatagctgggcatgcaaccccccagattgtccaggggttggtacaggttgtactgcctgtggattatatctagatcaattaaagccggtaggaacagcctttaaaattataagtgtaagatatagtagaaaagtgtgcgtgcagtttggtgaagaatacctttgcaaaacaattgatatgaatgattgctttgtgactaggcatgccaaaatatgtataattgggactgtatctaagttttctcaaggtgacactctactatttcttggacccatggaaggaggtggtataatctttaaacactggtgtacatctacctgtcactttggagaccctggtgatgtcatgggtccaaaagataaaccatttagttgccctgaattcccagggcaattcaggaaaaaatgtaactttgccacaactccaatttgtgaatatgatgggaacattatctcaggttataagaaagtccttgcaacaattgattcttttcaatcatttaacacaagcaatatacacttcactgatgagagaattgaatggagagaccctgatggtatgcttcgggatcatattaatatcgttatttctaaagatattgattttgaaaatttggctgagagtccttgtaaagtagggctccaggcagcaaacatagaaggtgcttggggttcaggtgtcgggtttacactcacatgccaggtgtctctcacagaatgcccaacatttcttacgtcaataaaggcctgtgacatggcaatttgttatggtgcagaaagtgtgacactttcacgaggacaaaatactgtcaggattactggaaaaggtggccatagtggttcttcatttaaatgctgtcatgggaaagaatgttcatcaactggcctccaagccagtgcaccacatttggataaagtaaatggtatctctgagttagaaaacgagaaagtttatgatgatggtgcacctgaatgtggcgttacttgttggtttaaaaaatcaggtgaatgggttatgggtataatcaacgggaactgggttgtcctaattgttttgtgtgtcctgttactcttttctcttatcctgttaagcattttgtgtcctgttagaaagcataaaaaatcataa

SEQ ID NO: 3431 - RNA, 3402 nt, synthetic construct
  misc_feature 1..3402: note = derived and/or modified CDS sequence (wt) from SEOV(Rn10-134)__JF693883.2__GP
  source 1..3402: mol_type = other RNA
atgtggagtttgctattactggccgctttagttggccaaggctttgcattaaaaaatgtgtttgacatgagaattcagtgtccccactcagtcaactttggggaaacaagtgtgtcaggctacacagaactgcccccactctcattacaggaggcagaacagctagtgccagagagctcatgcaacatggacaaccaccaatcactctcaacaataaataaattaaccaaggtcatatggcggaaaaaggcaaatcaggaatcagcaaaccagaattcatttgaagttgtggagagtgaagtcagctttaaagggttgtgtatgttaaagcatagaatggttgaagaatcatacagaaataggagatcagtaatctgttatgatctagcctgtaatagtacattctgtaagccaactgtctacatgattgttcctatacatgcatgcaacatgatgaaaagctgtttgattggtcttggtccctacagaatccaggttgtttatgaaaggacatactgcactacgggtatattgacagaaggaaaatgctttgttcctgacaaggctgttgtcagtgcattgaagagaggcatgtatgccatagcaagcatagagacaatctgcttttttattcatcagaaagggaatacatataagatagtgactgccatcacatcggcaatgggctccaagtgtaataatacagatactaaagttcaaggatattatatctgtattattggtggaaactctgcccctgtatatgcccctgctggtgaagactttagggcaatggaggttttttccgggattattacatcaccacatggagaagaccatgacctccctggcgaggaaattgcaacataccagatttcagggcagatagaggcaaaaatccctcatacagtgagctccaagaacttaaaattgactgcttttgcaggtattccatcatactcatcaactagtatattggctgcttcagaagatggtcgtttcatatttagtcctggtctatttcctaacctaaatcagtcagtttgtgacaacaatgcactccctttaatctggaggggcctaattgatttaacgggatactatgaagcagtccacccctgcaatgtattctgtgtcttatcaggaccaggtgcttcatgtgaagccttttcagaaggaggtattttcaatattacttccccaatgtgtcttgtgtccaagcaaaataggtttagagcagctgagcagcagatcagctttgtctgccaaagggttgatatggatattatagtgtactgtaatggtcagaaaaagacaatcctaacaaaaacattagttataggccaatgcatttatactattacaagtctcttttcactgttaccaggggttgcccattctattgctattgagttgtgtgttccaggatttcatggctgggccacagctgcacttctgatcacattctgctttggctgggtattgattcctgcatgtacattagctattcttttagttcttaagttttttgcaaatatcctccatacaagcaatcaagagaaccgattcaaagccattttgcggaaaataaaggaggagtttgaaaaaacaaagggttccatggtttgtgaaatctgtaagtacgagtgtgaaacattaaaggaattgaaggcacataatctgtcatgtgttcaaggggaatgcccatattgctttacccactgtgaaccgacagaaactgcaattcaggcacattacaaagtttgtcaagctacccaccgattcagagaagatttaaaaaagactgtaactcctcaaaatattgggcctggttgttaccgaacattaaatctttttaggtataaaagtaggtgttatattctgacaatgtggactcttcttctcattattgaatccatcctctgggcagcaagtgcagtggaaatcccacttgtccccctctggacagataatgctcatggtgttgggagtgttcctatgcatacagatcttgaattagacttttctttaccatctagttctaggtacacatataaaagacatctcacaaacccagttaatgaccagcagagtgtctcattgcatatagaaattgaaagtcaaggcattggtgctgatgtccatcatcttggacattggtatgatgcaagattgaatttaaaaacctcatttcattgttatggtgcctgcacaaaatatcaatatccatggcacactgcaaaatgccattttgagaaagattatgagtatgaaaacagctgggcatgcaaccccccagattgcccaggggttggtacaggttgtactgcttgcgggttatacctcgatcaattgaagccggtaggaacagccttcaaaatcataagtgtaagatacagcagaaaagtgtgcgtgcagtttggtgaagaatacctttgtaaaacaattgatatgaatgattgctttgtgactagacatgccaaaatatgtataattgggactgtatctaagttttctcaaggtgacactctactatttctagggcccatggaaggaggtggtataatctttaaacactggtgcacatcaacctgtcactttggagaccctggtgatgtcatgggtccaaaagataaaccatttatttgccctgaattcccagggcaattcaggaaaaaatgtaactttgccacaactccagtttgtgaatatgatgggaacattatttcaggctataagaaagttcttgcaacaattgattcttttcaatcgtttaacacaagcaatatacacttcactgatgaaagaattgaatggagagaccctgatggtatgcttcgggatcatattaatatcgttatttctaaagatattgattttgaaaatttggctgagaatccttgtaaagtagggctacaggcagcaaacatagaaggtgcctggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaaaattactgggaaaggtggccatagtggttcctcatttaagtgctgtcatgggaaagaatgttcattaactggcctccaagccagtgcaccacatttagataaggtaaatggtatctctgagttagagaatgagaaagtctatgatgatggtgcacctgaatgtggcattacttgttggtttaagaaatcaggtgaatgggttatgggtataatcaatgggaactgggttgtcctaattgtcttgtgtgtcctgctgctcttttctcttatcctgttgagcatcctatgtcctgttagaaagcataaaaaatcataa

SEQ ID NO: 3432 - RNA, 3402 nt, synthetic construct
  misc_feature 1..3402: note = derived and/or modified CDS sequence (wt) from SEOV(Gou3-e5)__AF288650.1__GP
  source 1..3402: mol_type = other RNA
atgtggggtttactattgctagccgctctggttggccaaggtttagcattaaaaaatgtctttgacatgaagatacagtgccctcattcagtaaactttggggaaacaagtgtgtcaggatatacagagttgcccccactcccactacaggaggcagaacagcttgtgccggaaagctcttgtaacatggacaatcaccaatcactctcaaccatcaataaactgaccaaggtaatatggagaaaaaaggcaaatcaggaatcagcaagtcagaattcatttgaggttgtggaaaatgaggtgagctttaaaggtttatgtatgctaaaacacagaatggtcgaggaatcatatagaaataggaggtcagtaatttgttatgatctggcatgtaatacaacattttgtaagccaactgtctacatgattgtcccaattcatgcttgcaacatgatgaaaagctgtttgatcggacttgggccctacagaatccaggtaatttatgagagaacttattgtactacagggatactgacagaaggaaagtgttttgtccctgataaggctgttgttagtgctttaaagagaggtatgtatgcaatagctagcatagaaacaatttgtttctttgttcatcaaaaaggaaacacatacaaaatagtatcagcaatcacatcagcaatgggctccaaatgcaataatacagattctaaggtccaaggatactacatatgcattattggtgggaattcagctcctgtttatgctcctgctggtgaagatttcagggcaatggaagttttttcaggaattattacatcaccacatggggaagatcatgacctcccaggtgaagagatagcaacataccagatctcaggtcaaatagaggctaagatcccccatactgtgagctctaaaaatctaaagcttactgcttttgcaggcattccatcttactcatcaacaagtatcttggctgcatcagaggatggcaggtttatattcagtccgggtttatttccaaatcttaatcagtctgtgtgtgataacaatgcacttcccttaatctggaggggtttaatagatttgacaggttactatgaagcaattcatccttgcaatgttttttgtgttttatcaggaccaggtgcatcatgtgaagctttttcagaaggtggtatttttaatatcacttctccgatgtgcctagtgtcaaaacaaaacagatttagggcagcagaacagcaaattagctttatttgtcaaagagtggatatggatatagttgtgtactgtaatgggcaaaaaaagacaattctgaccaaaacactagttattggccagtgcatatatactataacaagtctattttctttattacctggggttgcacattctattgctattgaactatgtgtaccaggtttccatggctgggctacagcagcacttctagttaccttctgttttggttgggttttaatccctgcatgtacattagctgttctattattcttaaagttttttgcaaatatcttacatacaagcaaccaagaaaacagattcaaggctatcctacgaaaaataaaggaggaatttgaaaaaacaaagggctcaatggtgtgtgaaatttgtaaatatgaatgtgaaacactaaaggaattaaaagctcacaatttgtcctgtgttcaaggggagtgcccatattgcttcacccattgcgagccaactgaaacagcaattcaggcccattataaagtctgtcaagctacccatcggttcagggaagatttaaaaaagactgtaacccctcaaaatattgggccaggttgttaccgtacactaaatctttttaggtacaagagcaggtgttatatcctgacaatgtggattctccttcttgtcattgaatctatattgtgggcagctagtgcagcagagattccccttgtccctttatggacagataatgcccatggagttggcagtgttccaatgcatacagatctggagcttgacttttccttaccatctagctctaaatacacatataaaaggcatcttacaaatccagtgaatgatcaacaaagtgtatcattacatattgaaatcgaaagccagggcattggtgctgatgttcaccatctcggacactggtatgatgcaagattaaacttaaagacatcatttcactgttatggtgcctgcacaaagtatcagtacccatggcatacagcaaaatgccacttcgagaaggattatgaatatgagaatagttgggcatgtaatccacctgattgccctggtgttgggacaggctgtactggctgtgggctttacttagatcaattaaagccagtaggaacagcttttaaaattataagcgtcagatatagtaggaaagtttgtgtccaatttggtgaagagtacctttgtaaaacaattgatatgaatgattgttttgtgactaggcatgccaagatctgtataatcgggactgtgtccaagttttctcaaggtgacactttattatttcttggacctatggaaggaggcggaattatcttcaaacattggtgcacatcaacctgccattttggagaccctggcgatgtcatgggcccaaaagataagccatttatatgtcccgaatttccaggccagttcagaaaaaaatgtaattttgctacgactccagtctgtgagtatgatggaaatgtcatttctggttatcggaaagttctggcaacaattgattcttttcaatcatttaatactagcaatgttcactttacagatgagaggattgaatggaaagatcctgacggtatgcttcgagaccatattaatattgtcatctctaaagatattgattttgaaaacttggctgaaaacccttgtaaagtaggccttcaagcagctaatatagaaggtgcctggggctcaggtgttggttttacacttacttgtcaagtatcgcttacagaatgcccaacatttctaacatctataaaggcttgtgacatggcaatttgttatggagcagaaagtgtaacactatcacggggccaaaacactataaaaatcacaggaaggggaggtcacagtggttcttccttcaaatgttgccatggtaaagagtgctcagcaaatggccttcaggcaagtgccccacatttggataaagtgaacggtatttctgagttagaaaatgaaaaggtttatgatgatggtgcacctgaatgtggtatcacttgttggttcaagaaatcaggtgaatgggttatgggtatcattaatggaaactgggttgtgttaattgtgttgtgtgtgttacttttgttttcacttattttgctaagcatattgtgtcctgttagaaagcataagaagtcatga

SEQ ID NO: 3433 - RNA, 3402 nt, synthetic construct
  misc_feature 1..3402: note = derived and/or modified CDS sequence (wt) from SEOV(China)__EU163437.1__GP
  source 1..3402: mol_type = other RNA
atgtggagtttgctattactggccgctttagttggccaaggctttgcattaaaaaatgtgtttgacatgagaattcagtgcccccactcagtcaagtttggggaaacaagtgtgtcaggctatacagaactgccgccactctcattacaggaggcagaacagctggtgccagagagctcatgcaacatggacaaccaccaatcactctcaacaataaataaattaaccaaggtaatatggcggaaaaaagcaaatcaggaatcagcaaaccagaattcatttgaaattttggagagtgaagtcagctttaaagggttgtgtatgttaaagcatagaatggttgaagaatcatacagaaacagaagatcagtaatctgttatgatctagcctgtaatagtacattttgtaagccaactgtttacatgattgttcctatacatgcatgcaacataatgaaaagctgtttgattggccttggtccctacagaatccaggttgtctatgaaaggacatactgcactacgggtatattgacagaaggaaaatgctttgtccccgacaaggctgttgtcagtgcattgaagagaggcatgtatgccatagcaagcatagagacaatctgcttttttattcatcaaaaagggaataaatataagatagtgactgccatcacatcagcaatgggctccaaatgtaataatacagatactaaagttcagggatattatatctgtattattggtggtaactctgcccctgtatatgcccctgctggtgaagactttagggcaatggaggttttttctgggattattacgtcaccgcatggagaagaccatgacctccctggcgaagaaatcgcaacataccagatttcagggcagatagaggcaaaaatccctcatacagtaagctctcaaaacttaaaattgactgcttttgcaggtattccatcatactcatcaactagtatattggctgcttcagaagatggtcgttttatatttagtcctggtttatttcctaacctaaatcagtcagtctgtgacaacaatgcactccctttaatctggaggggcctaattgatttaacgggatactatgaggcagtccatccctgcaatgtattctgtgtcttatcaggaccaggtgcttcatgtgaagccttttcagaaggaggtattttcaatattacttctccaatgtgtctggtgtctaagcaaaataggtttagagcagctgagcagcagatcagctttatctgccaaagggtcgatatggatattatagtgtactgtaatggtcaaaaaaagacaatcctaacaaaaacattagttataggtcaatgcatttatactattacaagtctcttttcactgttgccaggggttgcccattctattgctattgagttgtgtgttccaggttttcatggctgggccacagctgcacttttgatcacattttgctttggctgggtattaattcctgcatgtacattagctattcttttagttctcaagttttttgcaaatatcctgcagacaagcaatcaagagaatcgattcaaagccattctacggaaaataaaggaggagtttgaaaaaacaaagggttccatggtttgtgagatctgtaagtacgagtgtgaaacattaaaggaattaaaggcacataatctatcatgtgttcaaggggagtgcccatattgctttacccactgtgaaccgacagaaactgcaattcaggcacattacaaagtgtgtcaagccactcaccgattcagagaagatttaaaaaagactgtaactcctcaaaatattggccctggttgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttgggcattgttatgatgcaaggttgaatctaaaaacttcatttcattgctacggtgcctgcacaaaataccaatatccgtggcacaccgcaaaatgtcattttgagaaagattatgagtatgaaaatagttgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacacactactatttcttgggcccatggaaggaggtggtataatctttaaacactggtgtacatctacctgtcactttggagaccctggtgatgttatgggtccaaaagataaaccatttatttgccctgaattcccagggcaattcaggaagaaatgtaactttgccacaactccagtttgtgaatatgatgggaacattatttcaggctataagaaagttcttgcaacaattgattctttccaatcatttaacagaagctatatacacttcactgatgagagaattgaatggagagaccctgatggtatgcttcgggatcatattaatattgttatttctaaagatattgattttgaaaatttggccgagaatccttgtaaagtagggctccaggcagcaaacatagaaggtgcttggggtttaggtgtcgggttcacactcacatgccaggtgtctctcacagaatgcccaacatttctcacgtcaataaaggcctgtgacatggcaatttgttatggtgcagaaagtgtgacactctcacgagggcaaaatactgtcaaaattaccgggaaaggtggccatagtggttcttcatttaaatgctgtcatgggaaagaatgttcatcaactggccttcaagccagtgcaccacatctggataaggtcaatggtatctctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctgctgctcttttctcttatcctgttgagcatcttgtgtcctgttagaaagcataaaaaatcataa

SEQ ID NO: 3434 - RNA, 3402 nt, synthetic construct
  misc_feature 1..3402: note = derived and/or modified CDS sequence (wt) from SEOV(DPRK08)__JX853576.1__GP
  source 1..3402: mol_type = other RNA
atgtggagtttgctattattggccgctttagttggccaaggctttgcattaaaaaatgtttttgacatgagaattcagtgtccccactcagtcaactttggggaaacaagtgtgtcaggctacacagaattgcccccactctcattacaggaggcagaacagctagtgccagagagctcatgcaacatggacaaccaccaatcactctcaacaataaataaattaactaaggtaatatggcgaaaaaaagcaaatcaggaatcagcaaaccagaattcatttgaagttgtggagagtgaagtcagctttaaagggttatgtatgttaaagcatagaatggttgaagaatcatatagaaacaggagatcagtaatctgttatgatctcgcctgtaatagtacattttgtaagccaactgtttacatgattgttcccatacatgcttgcaacatgatgaaaagctgtttgattggccttggtccctacagaatccaggttgtctatgaaaggacatactgcactacgggtatattgacagaaggaaagtgctttgtccccgacaaggctgttgtcagtgcattaaagagaggcatgtatgccatagcaagcatagagacaatctgctttttcattcatcagaaagggaatacatataagatagtgactgccattacatcagcaatgggctccaaatgtaataatacagatactaaagttcaggggtattatatctgtattattggtggaaactctgcccctgtatatgcccctgctggtgaagactttagggcaatggaggttttttctgggattattacgtcaccgcatggagaagaccatgacctccctggtgaagaaattgcaacttaccagatttcagggcagatagaggcaaaaatccctcatacagtgagctctaaaaatttaaaattgactgcttttgcaggtattccatcatactcatcaactagtatattggctgcttcagaagatggtcgtttcatatttagtcctggtttatttcctaacctaaatcagtcagtttgtgataacaatgcactcccattaatctggagaggcctaattgatttaacgggatactatgaggcagtccacccttgcaatgtattttgtgtcttatcaggaccaggtgcttcatgtgaagccttttcagaaggaggtattttcaatattacttctccaatgtgtctggtgtccaagcaaaataggtttagagcagctgagcagcagatcagctttgtctgccaaagggtcgacatggatattatagtgtactgtaatggtcaaaaaaagacaatcctaacaaaaacattagttataggccaatgtatttatactattacaagtctcttttcactgttaccaggggttgcccattctattgctattgagttgtgtgttccaggctttcatggctgggccacagctgcacttttgatcacattctgctttggctgggtattgattcctgcatgtacattagctattcttctagttcttaagttttttgcaaatatccttcatacaagcaaccaagagaatcgattcaaagccattctacggaaaataaaagaggagtttgaaaaaacaaagggttccatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtttgtcaggccacccaccgattcagagaagatttaaagaagactgtaactcctcaaaatattgggccaggctgttaccgaacattgaatctttttaggtataaaagtagatgttatattctgacaatgtggactcttcttctcattattgaatccatcctctgggcagcaagtgcagcagaaatcccccttgtccctatctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttgggcattggtatgatgcaagattgaatctaaaaacctcattccattgctatggtgcttgcacaaaataccaatacccatggcacactgcaaaatgccattttgagaaagattatgagtatgaaaatagttgggcatgcaaccccccagattgcccaggggttggtacaggttgtactgcttgtggattatatctagatcaattgaagccggtaggaacagccttcaaaattataagtgtaagatacagtagaaaagtgtgcatgcagtttggtgaagaatacctttgtaaaacaattgatatgaatgattgctttgtgactaggcatgccaaaatatgtataattgggactgtatctaagttttctcaaggtgacactctactatttcttgggcccatggaaggaggtggtataatctttaaacactggtgtacatctacttgtcattttggagaccctggtgatgttatgggtccaaaagataaaccatttatttgccctgaattcccagggcaattcaggaaaaaatgtaattttgccacaactccagtttgtgaatatgatgggaacattatttcaggctataagaaagttcttgcaacaattgattctttccaatcatttaacacaagcaatatacacttcactgatgagagaattgaatggagagaccctgatggtatgcttcgggatcatattaatatcgttatttctaaagatattgattttgaaaatttggctgagaatccttgtaaagtagggctccaggcagcaaacatagaaggtgcttggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaagattactgggaaaggtggccatagtggttcttcatttaaatgctgtcatgggaaagaatgttcatcaactggccttcaagccagtgcaccacatctggataaggtaaatggtatctctgagttagaaaacgagaaagtttatgatgatggtgcacctgaatgtggtgttacttgttggtttaaaaaatcaggtgaatgggttatgggtataatcaatgggaactgggttgtcttaattgttttgtgtgtcctgctgctcttttctcttatcctgttgagcatcttatgtcctgttagaaagcataaaaaatcataa

SEQ ID NO: 3435 - RNA, 3402 nt, synthetic construct
  misc_feature 1..3402: note = derived and/or modified CDS sequence (wt) from SEOV(Fj372/2013)__KP645197.1__GP
  source 1..3402: mol_type = other RNA
atgtggagtttgctattattggccgctttagttggtccaggctttgcattaaaaaatgtgtttgacatgagaattcagtgtccccactcagtcaactttggggaaacaagtgtgtcaggctatacagaattgccaccactctcattacaggaggcagaacagctagtgccagagagctcatgtaacatggacaaccaccaatcactctcaacaataaataaattgaccaaggtgatatggcagaaaaaagcaaatcaagaatcagcaaaccagaattcatttgaagttgtggagagtgaagtcagctttaaagggttgtgtatgttaaagcatagaatggttgaagaatcatatagaaacaggagatcagtaatctgttatgatctagcctgtaatagtacattctgtaagccaactgtttatatgattgttcctatacatgcatgcaatatgatgaaaagctgtttgattggtcttggtccctacagaatccaggttgtctatgaaaggacatactgtactacgggtatattgacagaaggaaagtgctttgtccccgacaaggctgttgtcagtgcattgaagagaggcatgtatgccatagcaagcatagagacaatctgtttttttattcatcagaaaggaaatacatataagatagtgactgccattacatcagcgatgggctccaaatgtaataatacagatactaaagttcagggatattatatctgtattattggtggaaactctgcccctgtatatgcccctgctggtgaagactttagggcaatggaagttttttctgggattattacatcaccgcatggagaagaccatgacctccctggcgaagaaattgcaacataccagatttcagggcagatagaggcaaaaatccctcacacagtaagctctaaaaacttaaaattgactgcttttgcaggtattccatcatactcatcaactagtatattggctgcttcagaagatggtcgtttcatatttagtcctggtttatttcctaacctaaatcagtcagtctgtgataacaatgcactccctttaatctggaggggcctaattgatttaacggggtactatgaggcagtccacccttgcaatgtattctgtgtcttatcaggaccaggtgcttcatgtgaagccttttcagaaggaggtattttcaatattacttctccaatgtgcctggtatccaagcaaaataggtttagagcagctgagcagcagattagctttgtctgccaaagggttgatatggatattatagtgtactgtaatggtcaaaaaaagacaattctaacaaaaacattagttataggccaatgtatttatactattacaagtctcttttcactgttgccaggggttgcccattctattgctattgagttgtgtgttccagggtttcatggctgggctacagctgcacttttgatcacattttgctttggttgggtattaattcctgcatgtacattagctattcttctggttctcaagttttttgcaaatatccttcatacaagcaatcaagagaatcgattcaaagccattctacggaaaataaaagaggagtttgaaaaaacaaagggctccatggtttgtgagatctgtaagtacgagtgtgaaacattaaaagaattgaaggcacataatctatcatgtgttcaaggggagtgcccatattgctttacccactgtgaaccgacagaaactgcaattcaagcacattacaaagtgtgtcaagccacccaccgattcagagaagatttaaaaaagactgtaactcctcaaaatattggaccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtacacatataaaagacatcttacaaacccggttaatgaccaacagagtgtctcattgcatatagaaattgaaagtcaaggcattggtgctgatgttcatcatcttggacattggtatgatgcaagattgaatctaaaaacttcatttcattgctatggtgcctgcacaaaataccaatatccatggcacactgcaaaatgtcatttcgagaaagattatgagtatgaaaatagttgggcatgcaaccccccagattgcccaggggttggtacaggttgtactgcttgtggattatatctagatcaattgaagccggtaggaacagcctttaaaattataagtgtaagatacagtagaaaagtgtgtgtgcagtttggtgaagaatacctttgtaaaacaattgatatgaatgattgctttgtgactaggcatgccaaaatatgtataattgggactgtatctaagttttctcaaggtgacactctactatttcttgggcccatggaaggaggtggtataatctttaaacactggtgtacatctacctgtcactttggagaccctggtgatgttatgggtccaaaagataaaccatttatttgccctgaattcccagggcaattcagaaagaaatgtaattttgccacaactccagtttgtgaatatgatgggaatatcatttcaggctataagaaagttcttgcgacaattgattcttttcaatcgtttaacacaagcaatatacacttcactgatgagagaattgaatggagagaccctgatggtatgcttcgggatcatattaatattgtcatttccaaagatattgattttgaaaatttggccgagaatccttgtaaagtagggctccaggcagcaaacatagaaggtgcttggggttcaggtgttgggtttacactcacatgccaggtgtctctcacagaatgcccaacatttctcacgtcaataaaggcttgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactggccttcaagccagtgcaccacatctggataaggtaaatggtatctctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctactactcttttctcttatcctgttgagcatcttatgtcctgttagaaagcataaaaaatcatag

SEQ ID NO: 3436 - RNA, 3402 nt, synthetic construct
  misc_feature 1..3402: note = derived and/or modified CDS sequence (wt) from SEOV(HeB38)__JN377554.1__GP
  source 1..3402: mol_type = other RNA
atgtggagtttgctattattggccgctttagttggccaaggctttgcattaaaaaatgtgtttgacatgagaattcagtgtccccactcagtcaaatttggagaaacaagtgtgtcaggctatacagaattgcccccactctcattacaggaggcagaacagctagtgccagagagctcatgcaacatggacaaccaccaatcactctcaacaataaataaattaaccaaggtaatatggcagaaaaaagcaaatcaggaatcagcaaaccagaattcatttgaagttgcagagagtgaagtcagcttcaaagggttgtgcatgttaaagcatagaatggttgaagaatcatatagaaacaggagatcagtaatctgttatgatctagcctgtaatagcacattctgtaagccaactgtttacatgattgttcctatacatgcttgcaacatgatgaaaagctgtttgattggccttggtccctatagaatccaggttgtctatgaaaggacatactgcactacgggtatattgacagaaggaaaatgctttgtccctgacaaggctgttgtcagtgcattgaagagaggcatgtatgccatagcaagcatagagacaatctgcttttttatccatcagaaaggaaatacatataagatagtgactgccattacatcagcaatgggctccaaatgtaataatacagatactaaagttcagggatattatatctgtattattggtggaaactctgcccctgtatatgccccttctggtgaagactttagggcaatggaagttttttctgggattattatgtcaccgcatggagaagaccatgacctccctggcgaagaaatcgcaacataccagatttcagggcagatagaggcaaaaatccctcatacagtgagctccaaaaacttaaaattgactgcttttgcaggtattccatcatactcatcaactagtatattggctgcttcagaagatggtcgcttcatatttagtcctggtttatttcctaacctaaatcagtcagtctgtgataacaatgcacttcctctaatctggaggggcctaattgatttaacgggatactatgaggcagtccacccttgcaatgtattctgtgtcttatcaggaccaggcgcttcatgtgaagccttttcagaaggaggtattttcaatattacttctccaatgtgtctggtgtccaagcaaaataggtttagagcagctgagcagcagatcagctttgtctgccaaagggtcgacatggatattatagtgtactgtaatggtcaaaaaaagacaatcctaacaaaaacattagttataggccaatgtatttatactattacaagtctcttttcactgttaccaggggttgcccattctattgctattgagttgtgtgttccagggtttcatggctgggccacagctgcacttttgatcacattctgctttggctgggtattgattcctgcatgtacattagctattcttctagttcttaagttttttgcaaatatccttcatacaagcaatcaagagaatcgattcaaagctattctacggaaaataaaggaggagtttgaaaaaacaaagggttccatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtttgtcaagccacccaccgattcagagaggatttaaaaaagactgtaactcctcaaaatattggcccaggctgttaccgaacattgaatcttttcaggtataaaagtaggtgttatattctgacaatgtggactcttcttctcattattgaatccatcctctgggcagcaagtgcggcagaaatccccctagtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttggacattggtatgatgcaagattgaatctaaaaacctcatttcattgctacggtgcctgcacaaaataccaatatccatggcatactgcaaaatgccattttgagaaagattatgagtatgaaaatagttgggcatgcaaccccccagattgcccaggggttggtacaggttgtactgcttgcggattatacctagatcaattgaagccagtaggaacagccttcaagattataagtgtgagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactatttcttgggcccatggaaggaggtggtataatctttaaacactggtgtacatctacctgtcactttggagaccctggtgatgttatgggtccaaaagataaaccatttatttgccctgaattcccagggcaattcagaaagaaatgtaattttgccacaactccagtttgtgaatatgatgggaacattatttcaggctataagaaagttcttgcgacaattgattctttccaatcatttaacacaagcaatatacacttcactgatgagagaattgaatggagagatcctgatggtatgcttcgggatcatattaatattgttatttctaaagatattgattttgaaaatttggccgagaatccttgtaaagtagggctccaggctgcaaacatagaaggtgcttggggttcaggtgtcgggttcacactcacatgccaggtgtctctcacagaatgcccgacatttcttacgtcaataaaggcctgtgacatggcaatctgttatggtgcagaaagtgtgacactcttacgaggacaaaatactgtcaaaattaccgggaaaggtggccacagtggttcttcatttaaatgctgtcatgggaaagaatgttcatcaactggtcttcaagccagtgcaccacacctggataaggtaaatggcatttctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctgctacttttttctcttatcctgttgagcatcttgtgtcctgttagaaagcataaaaaatcataa

SEQ ID NO: 3437 - RNA, 3402 nt, synthetic construct
  misc_feature 1..3402: note = derived and/or modified CDS sequence (wt) from SEOV(JiangxiXinjianRn-07-2011)__KP859513.1__GP
  source 1..3402: mol_type = other RNA
atgtggagtttgctattactggccgctttagttggccaatgctttgcattaaaaaatgtatttgacatgagaattcagtgtccccactcagtcaactttggggaaacaagtgtgtcaggctatacagaattgcctccactctcattacaggaggctgaacagctagtgccagagagctcatgtaacatggacaaccaccaatcactctcaacaataaataaattaactaaggtcatatggcggaaaaaagcaaatcaggaatcagcgaaccagaattcctttgaagttgtagagagtgaagtcagctttaaagggttgtgtatgttaaagcatagaatggttgaagaatcatatagaaacaggagatcagtaatctgttatgatctagcatgtaatagcacattctgtaagccaactgtttacatgattgttcctatacatgcctgcaacatgatgaaaagctgtttgattggccttggtccctacagaatccaggttgtctatgaaaggacatactgcactacaggtatattgacagaaggaaaatgctttgtccccgacaaggctgttgttagtgcattgaagagaggcatgtatgccatagcaagcatagagacaatctgcttttttattcatcagaaaggaaatacatataaaatagtgactgccattacatcggcaatgggctccaaatgtaataatacagatactaaagttcaaggatattatatttgtattataggtggaaactccgcccctgtatatgcccctgctggtgaagactttagggcaatggaggttttttctgggattattacatcaccacatggagaagaccatgacctccctggtgaagaaattgcaacataccaaatttcagggcagatagaggcaaaaatccctcatactgtaagctctaaaaacttaaaattgactgcttttgcaggtattccatcatactcatcaactagtatattggctgcttcagaagatggtcgtttcatattcagccctggtttgtttcccaacctaaatcagtcagtctgtgataacaatgcactccctttaatctggaggggcctgattgatttaacgggatactatgaggcagtccacccttgtaatgtattctgtgtcttatcaggaccaggtgcttcatgtgaagccttttcagaaggaggtattttcaatattacttccccaatgtgtctggtgtccaagcaaaataggtttagagcagctgagcagcagattagctttgtctgtcaaagggttgatatggatattatagtatactgcaatggtcaaaaaaagacaatcctaacaaaaacattagttatcggccaatgtatttacactattacaagtctcttttcactgctaccaggggtggcccattctattgctattgagttgtgtgttccaggtttccatggctgggccacagctgcacttttgatcacattctgctttggctgggtattaatacctgcatgtacattagctattcttttagttctcaaattttttgcaaacatccttcatacaagcaatcaagagaaccgattcaaagccattctacgtaaaataaaggaggagtttgaaaaaacaaagggttccatggtttgtgagatttgtaaatacgaatgtgaaacattaaaggaattgaaggcacataatctatcatgtgttcaaggggagtgcccatattgctttacccactgtgaaccgacagaaactgcaattcaggcacattacaaagtttgccaagccacccatcgattcagagaagatttaaaaaagactgtaactcctcaaaatatcgggccgggctgttaccgaacattaaatctttttaggtataaaagtagatgttatattctgacaatgtggactcttcttctcattattgaatccatcctctgggcagcaagtgcagcagaaattccccttgtccctctctggacagataatgctcatggcgtcgggagtgttcctatgcatacagatcttgaattagacttttctttgccatccagttctaaatacacatataaaagacatctcacaaacccagttaacgaccaacagagtgtctcattgcacatagaaattgaaagtcaaggtattggtgctgatgttcatcatcttggacattggtatgatgcaagattgaatttaaaaacctcatttcattgttatggtgcctgcacaaaatatcaatatccatggcacactgcaaaatgtcattttgagaaagattatgagtatgaaaatagttgggcatgcaaccccccagattgcccaggggttggtacaggttgtactgcttgtggattatatttagatcaattgaagccagtaggaacagccttcaaaattataagtgtaagatacagtagaaaagtgtgcgtgcagtttggtgaagaatacttttgtaaaacaattgatatgaatgattgctttgtgactaggcatgccaaaatatgtataattgggactgtatctaagttttctcagggtgacactctactatttcttgggcccatggaaggaggtggtataatctttaaacactggtgtacatctacttgtcactttggagaccctggtgatgtcatgggtccaaaagataaaccatttatttgccctgaattcccagggcaatttaggaaaaaatgtaactttgccacaactccggtttgtgaatatgatgggaacattatctcaggttataagaaagttcttgcaacaattgattctttccaatcatttaacacaagcaatatacacttcactgatgagagaattgaatggagagaccctgatggtatgcttcgggatcatattaacatcgttatttctaaagatattgattttgaaaatttggctgagaatccttgtaaagtagggctccaggcagcaaacatagaaggtgcttggggttcaggtgtcgggtttacactcacatgccaggtgtctctcacagaatgcccaacatttctcacgtcaataaaggcctgtgatatggcaatttgttatggtgcagaaagtgtgacactttcacgaggacaaaacactgtcaaaattaccgggaaaggtggccatagtggttcttcatttaaatgctgtcatggaaaagaatgctcatcaactggcctccaagccagtgcaccgcatttggataaggtaaatggtatatctgagttagaaaacgagaaagtttatgatgatggtgcaccagaatgtggcattacttgctggtttaaaaaatcaggtgagtgggttatgggtataatcaatgggaactgggttgtcctaattgttttgtgtgtcttgttgcttttttctcttatcctgttaagcattttgtgtcctgttagaaagcataaaaaatcatga

SEQ ID NO: 3438 - RNA, 3402 nt, synthetic construct
  misc_feature 1..3402: note = derived and/or modified CDS sequence (wt) from SEOV(LYON/Rn/FRA/2013/LYO852)__KF387724.1__GP
  source 1..3402: mol_type = other RNA
atgtggagtttgctattactggccgctttagctggccaaggttttgcattaaaaaatgtgtttgacatgagaattcagtgtccccactcagttaactttggggaaacaagtgtgtcaggctacacagaattgcccccactctcattacaggaggcagaacaactagtgccagagagctcatgtaacatggacaaccaccaatcactctcaacaataaataaattaaccaaggtcatatggcggaaaaaagcaaatcaagaatcagcaagccagaattcatttgaagttgtggagagtgaagtcagctttaaagggttgtgtatgttaaggcatagaatggttgaagaatcatataaaaataggagatcagtaatctgttatgatctagcctgtaatagtacattctgtaagccaactgtatacatgattgttcctatacatgcttgcaacatgatgaaaagctgtttgattggccttggtccctacagaatccaggttgtctatgaaaggacatactgcactacgggtatattgacagaaggaaaatgctttgtccccgacaaggctgttgttagtgcattgaagagaggcatgtatgccatagcaagcatagagacaatctgcttttttattcatcagaaagggaatacatataagatagtgactgccattacatcggcaatgggctccaaatgtaataacacagatactaaagttcaaggatattatatctgtattattggtggaaactccgcccctgtatatgcccctgctggcgaagactttagggcaatggaggttttttctgggattattacatcaccacatggagaagaccatgacctccctggcgaagaaattgcaacataccagatttcagggcagatagaggcaaaaatccctcatacagtgagctccaaaaacttgaaattgactgcttttgcaggtattccatcatactcatcaactagtatattagctgcttcagaagatggtcgtttcatctttagtcctggcttatttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttccccaatgtgtctggtgtctaagcaaaataggtttagagcagctgagcagcagatcagctttgtctgccaaagggttgatatggatattatagtgtactgtaatggtcagaaaaagacaatcttaacaaaaacattagttataggccagtgtatttatactattaccagtctcttttcactgctaccaggggttgcccattctattgctattgagttgtgtgttccagggtttcatggctgggccacagctgcacttttgatcacattctgctttggctgggtattgattccagcatgtacattagctattcttttagttctcaagttttttgcaaatatccttcatacaagcaatcaagagaaccgatttaaagccatcctacgaaaaataaaggaggagtttgaaaaaacaaagggttccatggtttgtgagatctgtaaatatgagtgtgaaacattaaaggagttgaaggcacataatctatcatgtgttcaaggggagtgcccatattgctttactcactgtgaaccgacagaaactgcaattcaggcacattataaagtttgtcaagctacccaccgattcagagaagatttaaaaaagactgtaactcctcagaatattgggccaggttgttatcgaacattaaatcttttcaggtataaaagtaggtgttacattctgacaatgtggactcttcttctcattattgaatccatcctttgggcagcaagtgcagcagaaatcccccttgtccctctctggacagataatgctcatggcgttgggagtgttcctatgcatacagatctcgaattagacttttctttgccatctagttctaagtacacatataaaagacatctcacaaacccagttaatgaccaacagagtgtctcattgcacatagaaattgaaagtcaaggcattggtgctgatgttcatcatcttggacactggtatgatgcaagattgaacctaaaaacctcatttcattgttatggtgcctgcacaaaataccaatatccatggcacactgcaaaatgccattttgagaaagattatgagtatgaaaatagttgggcatgcaaccccccagattgcccaggggttggtacaggttgtactgcttgtggattatatctagatcaattgaagccggtaggaacagccttcaaaattataagtgtaagatatagtagaaaagtgtgcgtgcagtttggtgaagaatacctttgtaaaacaattgatatgaatgattgctttgtgactaggcatgccaaaatatgtataattgggactgtatcaaagttttctcaaggtgacactctactatttctggggcccatggaaggaggtggtataatcttcaaacactggtgtacatctacttgtcactttggagaccctggtgatgtcatgggtccaaaagataaaccatttatttgccctgaatttccagggcaattcaggaagaaatgtaattttgccacaactccagtttgtgaatatgatgggaacatcatctcaggctacaagaaagttcttgcaacaattgattctttccaatcattcaacacaagcaatatacacttcactgatgaaagaattgaatggagggaccctgatggtatgcttcgagatcatattaatattattatttcaaaagatattgattttgaaaatttggctgagaatccttgtaaagtagggctccaggcagcaaacatagaaggtgcttggggttcaggtgtcgggtttacactcacatgccaggtttctctcacagaatgcccaacatttctcacatcaataaaggcctgtgacatggccatttgttatggtgcagaaagtgtgacactctcacgagggcaaaatactgtcaaaattaccgggaaaggtggccatagtggttcttcatttaaatgctgtcatgggaaagaatgttcattgactggtctccaagccagtgcaccacatctggataaggtaaatggtatctctgagttagaaaacgagaaggtttatgatgatggtgcacctgaatgtggcattacttgttggtttaaaaaatcaggtgaatgggttatgggtataatcaatgggaactgggttgtcctaattgttttgtgtgtctttttgctcttttctcttatcctgttgagcattttgtgtcctgtgagaaagcataaaaaatcatag

SEQ ID NO: 3439 - RNA, 3402 nt, synthetic construct
  misc_feature 1..3402: note = derived and/or modified CDS sequence (wt) from SEOV(Seoul-Baxter/NYC-D1_M)__KJ950863.1__GP
  source 1..3402: mol_type = other RNA
atgtggagtttgctattacttgccgctttagttggccaaggctttgcattaaaaaatgtgtttgacatgaaaatccagtgtccccactcagtcaactttggggaaacaagtgtgtcaggctatacagaactgcccccactctcattacaagaggcagaacagctagtaccagagagctcatgcaacatggacaaccaccaatcactctcaacaataaataaattgaccaaagtcatatggcgaaagaaagcaaatcaggaatcagcaaaccagaactcatttgaagttgctgagagtgaagtcagctttaaagggttgtgtatgttaaagcatagaatggttgaagaatcatacagaaacaggagatcagtgatctgttatgatctagcctgtaatagtacattctgtaagccaaccgtttacatgattgttcctatacatgcttgcaacatgatgaaaagctgtttaattggccttggtccctatagaattcaggttgtctatgaaaggacatactgcactacaggtatattgacagaagggaaatgctttgtccccgacaaggctgttgtcagtgcattgaagagaggcatgtatgccatagcaagcatagagacaatctgcttttttattcatcagaaagggaacacatataagatagtgactgccattacatcggcaatgggctccaaatgtaatgatacagatactaaagttcaagggtattatatctgtattattggtggaaactctgcccctgtatatgcccctgctggtgaagactttagggcaatggaggttttttctgggattatcacatcaccacatggagaagatcatgacctccctggcgaagaaatcgcaacataccagatttcagggcagatagaggcaaaaatccctcatacagtaagctctaaaaacttaaaattgactgcttttgcaggcattccatcatactcatcaaccagcatactggctgcttcagaagatggtcgcttcatatttagtcctggtctatttcctaacctaaatcaatcagtctgtgacaataatgcactccctttagtctggaggggtctaattgatttaacgggatactatgaggcagtccacccttgcaatgtattctgtgtcttatcaggaccaggtgcttcatgtgaagccttttcagaaggaggtatttttaatattacttctccaatgtgtctggtatccaaacaaaataggtttagagcagctgagcagcagatcagttttgtttgccaaagggttgatatggatattatagtgtactgtaatggtcaaaaaaagacaatcctaacaaaaacattagttataggccaatgtatttatactattacaagtctcttttcactgttaccgggggttgcacattctattgctattgagctttgtgtcccagggtttcatggctgggccacagctgcacttttgatcacattctgctttggctgggtattaatccctgcatgtacattagctattctattagtcctcaagttttttgcaaatatccttcatacaagtaatcaagaaaaccgattcaaagccattctacgaaaaataaaggaagagtttgaaaaaacaaagggttccatggtttgtgagatctgcaagtatgagtgtgaaacattaaaggaattgaaggcacataacctatcatgtgttcaaggggagtgcccatattgcttcacccactgtgaaccaacagagactgcaattcaggcacattataaagtttgtcaagccacccaccggttcagggaagatttaaaaaagactgtaactcctcaaaatattgggccgggctgttaccgaacactaaacctttttaggtataaaagtaggtgttatattctgacaatgtggactcttcttctcattattgaatccatcctctgggcagctagtgcagcagaaatcccccttgtccctctctggacagataatgctcatggcgttgggagtgttcccatgcatacagaccttgaattagatttttctttgccatctagctctaagtacacatacaaaagacatctcacaaacccagttaatgaccaacagagtgtctcattgcatatagaaattgagagtcaaggcattggtgctgatgttcatcatcttggacattggtatgatgcaagattaaatctaaaaacctcatttcattgctatggtgcctgcacaaaatatcaatatccatggcacactgcaaaatgtcattttgagaaagattatgagtatgaaaatagctgggcttgcaaccccccggattgccccggggttggcacaggttgtactgcttgtggattatatctagatcaactgaagccagtaggaacagccttcaaaattataagtgtaagatacagcagaaaagtgtgcttgcagtttggtgaagaatacctctgtaaaacgattgatatgaatgattgctttgtgacaaggcatgttaaaatatgtataattgggactgtatctaagttttctcaaggtgacactctactatttcttggacccatggagggaggtggtataatctttaaacactggtgtacatctacctgtcactttggagaccctggtgatgtcatgggtccaaaagataaaccatttatttgccctgaattcccaggacaatttaggaaaaaatgtaactttgccacaactccggtttgtgaatatgatgggaacattatttcaggatataaaaaagttcttgcaacaattgattctttccaatcatttaacacaagcaatatacactttactgatgagagaattgaatggagagaccctgatggtatgcttcgggaccatattaatatcgttatttctaaagatattgattttgaaaatttagctgagaatccttgtaaagtagggctccaggcagcaaacatagaaggtgcttggggttcaggtgttgggtttacactcacatgccaggtgtctctcacagaatgtccaacatttctcacgtcaataaaggcatgtgacatggcaatttgttatggtgcagaaagtgtgacactctcacgaggacagaatactgtcaagatcaccgggaaaggtggccatagtggttcttcatttaaatgctgtcatgggaaggaatgttcatcaactggcctacaagccagtgcaccgcatctagataaggtaaatggtatttctgagttggaaaacgagaaagtttatgatgatggtgcacctgaatgtggcattacttgttggtttaaaaagtcaggtgaatgggttatgggtataattaatgggaattgggttgtcttaattgttttgtgtgtcctcttacttttttctcttatcctgttgagcattttgtgtcctgttaggaagcataaaaaatcataa

SEQ ID NO: 3440 - RNA, 3402 nt, synthetic construct
  misc_feature 1..3402: note = derived and/or modified CDS sequence (wt) from SEOV(Singapore/06(RN41))__GQ274942.1__GP
  source 1..3402: mol_type = other RNA
atgtggagtttgctattattggctgctttagctggccaaggttttgcattaaaaaatgtgtttgacatgagaattcagtgtccccactcagttaactttggggaaacaagtgtgtcaggctacacagaattgcccccactctcattacaggaggcagaacagctagtgccagagagctcctgcaacatggacaaccaccaatcactctcaacaataaataaattaaccaaggtcatatggcggaaaaaagcaaatcaggaatcagcaagccagaattcatttgaagttgtggagagtgaaatcagctttaaagggttgtgtatgttgaagcatagaatggttgaagaatcatatagaaacaggagatcagtaatctgttatgatctagcctgtaatagtacattctgtaagccaactgtatacatgattgttcctatacatgcttgtaacatgatgaaaagctgtttgattggccttggtccttacagaatccaggttgtctatgaaaggacatactgcactacaggtatattgacagaaggaaaatgctttgtccccgacaaggctgttgtcagtgcattgaagagaggcatgtatgccatagcaagcatagagacaatctgcttttttattcatcagaaagggaatacatataagatagtgactgccattacatcggcaatgggctccaaatgcaataatacagatactaaagttcaaggatattatatctgtatcattggtggaaactccgcccctgtatatgcccctgctggtgaagactttagggcaatggaggttttttctgggattattacatcaccgcatggagaagaccatgacctccctggcgaagaaattgcaacataccagatttcagggcagatagaagcaaagatccctcatacagtgagctccaaaaacttaaaattgactgcttttgcaggtattccatcatactcatcaactagtatattagctgcctcagaagatggtcgtttcatatttagtcctggcttatttcctaacctaaatcagtcagtctgtgacaacaatgcacttcctttaatctggaggggcctaattgatttaacaggatactatgaggcagtccacccttgcaatgtattctgtgtcttgtcaggaccaggtgcttcatgtgaagccttttcagaaggaggtattttcaatattacttctccaatgtgtctggtgtctaagcaaaatagatttagagcagctgagcagcagatcagctttgtctgccaaagggttgatatggatattatagtgtactgtaatggtcagaaaaagacaatcctaacaaaaacattagttataggccagtgtatttatactattacaagtctcttttcactgctaccaggggttgcccattctattgctattgagttgtgtgttccagggtttcatggctgggccacagctgcacttttgatcacattctgctttggctgggtattgattcctgcatgtacattagctattcttttagttctcaagttttttgcaaatatccttcatacaagcaatcaagagaaccgatttaaagccatcctaaggaaaataaaggaggagtttgaaaaaacaaagggttccatggtttgtgagatctgtaaatatgagtgtgaaacattaaaggagttgaaggcacataatctatcatgtgttcaaggggagtgcccatattgctttacccactgtgaaccgacagaaactgcaattcaggcacattacaaagtttgtcaagccacccaccgattcagagaagatttaaaaaagactgtaactcctcaaaatattgggccaggttgttatcgaacattaaatctttttaggtataaaagtaggtgttacattctgacaatgtggactcttcttctcattattgaatccatcctttgggcagcaagtgcagcagaaatcccccttgtccccctctggacagataatgctcatggcgttgggagtgttcctatgcatacagatctcgaattagacttttctttgccatccagttctaagtacacatataaaagacatctcacaaacccagttaatgaccaacagagtgtatcattacatatagaaattgaaagtcaaggcattggtgctgatgttcatcatcttggacactggtatgatgcaagattgaatctaaaaacctcatttcattgttacggtgcttgcacaaaataccaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtatgcgtgcagtttggtgaagaatacctctgtaaaacaattgatatgaatgattgctttgtaactaggcatgccaaaatatgtataattgggactgtatctaagttttctcaaggtgacactctactatttctggggcccatggaaggaggtggtataatctttaaacactggtgtacatctacttgtcactttggagaccctggtgatgtcatgggtccaaaagataaaccgtttatttgccctgaatttccagggcagttcaggaaaaagtgtaactttgccacaactccagtttgtgaatatgatgggaatatcatctcaggctataagaaagttcttgcaacaattgattcttttcaatcatttaatacaagcaatatacacttcactgatgaaagaattgaatggagggaccctgatggtatgcttcgggatcatattaatatcgttatttcaaaagatattgattttgaaaatttggctgagaatccttgtaaagtagggctccaggcagcaaacatagaaggtgcttggggttcaggtgtcgggtttacactcacatgccaggtgtctctcacagaatgcccaacatttctcacatcaataaaggcctgtgacatggccatttgttatggtgcagaaagtgtgacactctcacgaggacaaaatactgtcaaaattaccgggaaaggtggccatagtggttcttcatttaaatgctgtcatgggaaagaatgttcatcgactggccttcaagccagtgcaccacatctggataaggtaaatggtatctctgagttagaaaatgagaaggtttatgatgatggtgcacctgaatgtggcattacttgttggtttaaaaaatcaggtgaatgggttatgggtataattaatggaaactgggttgtcctaattgttttgtgtgtcttgttgctcttttctcttatcctgttgagcattttgtgtcctgtgagaaagcataaaaaatcataa

SEQ ID NO: 3441 - RNA, 3402 nt, synthetic construct
  misc_feature 1..3402: note = derived and/or modified CDS sequence (wt) from SEOV(11CSG)__AB618131.1__GP
  source 1..3402: mol_type = other RNA
atgtggagtttgctactgttggctgctttagctggccaaggttttgcattaaaaaatgtgtttgacatgagaattcagtgtccccactcagttaactttggagaaacaagtgtgtcaggctacacagaattgcccccactctcattacaggaggcagaacagttagtgccagagagctcatgcaacatggacaaccaccaatcactctcaacaataaataaattaaccaaggtcatatggcggaaaaaagcaaatcaggagtcagcaagccaaaattcatttgaagttgtggagagtgaagtcagctttaaagggttgtgtatgttaaagcatagaatggttgaagaatcatatagaaacaggagatcagtaatctgttatgatctagcctgtaatagtacattttgtaagccaactgtatacatgattgttcctatacatgcttgcaacatgatgaaaagctgtttgattggccttggtccctacagaatccaggttgtctatgaaaggacttactgcactacgggtatattgacagaaggaaagtgctttgtccccgacaaggctgttgtcagtgcattgaagagaggcatgtatgccatagcaagcatagagacaatctgcttttttgttcatcaaaaagggaatacatataagatagtgactgccattacatcagcaatgggttctaaatgtaataatacagatactaaagttcaaggatattatatctgtattattggtggaaactctgcccctgtatatgcccctgctggtgaagactttagggcaatggaggttttttctgggattattacatcaccgcatggagaagaccatgacctccctggcgaagaaattgcaacataccagatttcagggcagatagaggcaaaattccctcatacagtgagctccaaaaacttaaaattgactgcttttgcaggtattccatcatactcatcaactagtatattagctgcttcagaagatggtcgttttatatttagtcctggcttatttcctaacctcaatcagtcagtctgtgacaacaatgcactccctttaatctggaggggcctaattgatttaacgggatactatgaggcagtccacccttgcaatgtattctgtgttttatcaggaccaggtgcttcatgtgaagccttttcagaaggaggtattttcaatattacttctccaatgtgtctggtgtctaagcaaaataggtttagagcagctgagcagcagatcagctttgtctgccaaagggttgatatggatattatagtgtattgtaatggtcagaaaaaaacaatcctaacaaagacattagttataggccagtgtatttatactattacaagtcttttttcactgctaccaggggttgcccattctattgctattgagttgtgtgttccagggtttcatggctgggctacagctgcactattgatcacattctgctttggctgggtattgattcctgcatgtacattagctattcttttagttctcaagttttttgcaaatatccttcatacaagcaatcaagagaaccgatttaaagccatcctacggaaaataaaggaggagtttgaaaaaacaaagggttccatggtttgtgagatctgtaaatacgagtgtgaaacattaaaggagttgaaggcacataatctatcatgtgttcaaggggagtgcccatattgcttcactcactgtgaaccgacagaaactgcaattcaggcacattacaaagtttgtcaagccacccaccgattcagagaagatttaaaaaagactgtaactcctcagaatattgggccaggttgttatcgaacattaaatcttttcaggtataaaagtaggtgttacattctgacaatgtggactcttcttctcattattgaatccatcctttgggcagcaagtgcagcagaaatcccccttgttcccctctggacagataatgctcatggcgttgggagtgttcctatgcatacagacctcgaattagacttttctttgccatccagttctaaatacacatataaaagacatctcacaaacccagttaatgatcaacagagtgtctcattgcacatagaaattgaaagtcaaggcattggtgctgatgttcatcaccttggacactggtatgatgcaagattgaatctaaaaacctcatttcattgttatggtgcctgcacaaaataccaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtatgtgtgcagtttggtgaagaatacctttgtaaaacaattgatatgaatgattgctttgtgactaggcatgccaaaatatgtataattgggactgtatctaagttttctcaaggtgacactctactatttctggggcccatggaaggaggcggtataatctttaaacactggtgtacatctacttgccactttggagaccctggtgatgtcatgggtccaaaagataaaccatttatttgccctgaatttccagggcaattcaggaaaaaatgtaactttgccacaactccagtttgtgaatatgatgggaataccatctcaggctataagaaagttcttgcaacaattgattctttccaatcatttaacacaagcaatatacatttcactgatgaaagaattgaatggagggaccctgatggtatgcttcgggatcatattaatattgttatttcaaaagatattgattttgaaaatttggctgagaatccttgtaaagtagggctccaggcagcaaacatagaaggtgcttggggttcaggtgttgggtttacactcacatgccaggtgtctctcacagaatgcccaacatttctcacatcaataaaggcctgtgacatggccatttgttatggtgcagaaagtgtgacactctcacgaggacaaaatactgtcaaaattaccgggaaaggtggccatagtggttcttcatttaaatgctgtcatgggaaagaatgttcatcaactggtcttcaagccagtgcaccacatctggataaggtaaatggtatctctgagttagaaaatgagaaggtttatgatgatggtgcacctgaatgtggcattacttgttggtttaaaaaatcaggtgaatgggttatgggtataatcaatgggaactggattgtcctaattgttttgtgtgtcttgttgctcttttctcttatcctgttgagcattttgtgtcctgtgagaaagcataaaaaatcataa

SEQ ID NO: 3442 - RNA, 3402 nt, synthetic construct
  misc_feature 1..3402: note = derived and/or modified CDS sequence (wt) from SEOV(5CSG)__AB618130.1__GP
  source 1..3402: mol_type = other RNA
atgtggagtttgctattactggccgctttagctggccaaggttttgcattaaaaaatgtgtttgacatgagaattcagtgtccccactcagttaactttggggaaacaagtgtgtcaggctacacagaattgcccccactctcattacaggaggcagaacaattagtgccagagagctcatgcaacatggacaaccaccaatcactctcaacaataaataaattaaccaaggtcatatggcggaaaaaagcaaatcaagagtcagcaagccaaaattcatttgaagttgtggagagtgaagtcagctttaaagggttgtgtatgttaaagcatagaatggttgaagaatcatatagaaacaggagatcagttatctgttatgatctagcctgtaatagtacattctgtaagccaactgtatacatgattgttcctatacatgcttgcaacatgatgaaaagctgtttgattggtcttggtccctacagaatccaggttgtctatgaaaggacttactgcactacgggtatattgacagaaggaaaatgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcaaggatattatatctgtattattggtggaaactctgcccctgtatatgcccctgctggtgaagactttagggcaatggaggttttttctggaattattacatcaccgcatggagaagaccatgacctccctggcgaagaaatcgcaacataccagatttcagggcagatagaggcgaaaatccctcatacagtgagctccaaaaacttaaaattgactgcttttgcaggtattccgtcatactcatcaactagtatattagctgcttcagaagatggtcgttttatatttagtcctggcttatttcctaacctcaatcagtcagtctgtgacaacaatgcactccctttaatctggaggggcctaattgatttaacaggatactatgaggcaatccacccttgcaatgtattctgtgtcttatcaggaccaggtgcttcatgtgaagccttttcagagggaggtattttcaatattacttctccaatgtgtctggtgtctaagcagaataggtttagagcagctgagcagcagatcagctttgtctgccaaagggttgatatggatattatagtgtattgtaatggtcagaaaaagacaatcctaacaaaaacattagttataggccagtgtatttatactattacaagtctcttttcactgctaccaggggttgcccattctattgctattgagttgtgtgttccagggtttcatggctgggccacagctgcacttttgattacattctgctttggctgggtattgattcctgcatgtacattagctattcttttagttctcaagttttttgcaaatatccttcatacaagcaatcaagagaaccgatttaaagccatcctacggaaaataaaggaggagtttgaaaaaacaaagggttccatggtttgtgagatctgtaaatacgagtgtgaaacattaaaggagttgaaggcacataatctatcatgtgttcaaggggagtgcccatattgctttactcactgtgaaccgacagaaactgcaattcaggcacattacaaagtttgtcaagccacccaccgattcagagaagatttaaaaaagactgtaactcctcagaatattgggccaggttgttatcgaacattaaatcttttcaggtataaaagtaggtgttacattctgacaatgtggactcttcttctcattattgaatccatcctttgggcagcaagtgcagcagaaatcccccttgtccccctctggacagataatgctcatggcgttggaagtgttcctatgcatacagatcttgaattagacttttctttgccatccagttctaaatacacatataaaagacatctcacaaacccagttaatgatcaacagagtgtctcagtgcacatagaaattgaaagtcaaggcattggtgctgatgttcatcatcttggacactggtatgatgcaagattgaatctaaaaacctcatttcattgttatggtgcctgcacaaaataccaatatccatggcacactgcaaaatgccattttgagaaagattatgagtatgaaaatagctgggcatgcaaccccccagattgcccaggggttggtacaggttgtactgcttgtggattatatctagatcaattgaagcctgtaggaacagccttcaaaattataagtgtaagatacagtagaaaagtgtgcgtgcagtttggtgaagaatacctttgtaaaacaattgatatgaatgattgctttgtgactaggcatgccaaaatatgtataattggaactgtatctaagttttctcaaggtgacactctactatttctggggcccatggaaggaggtggtataatctttaaacactggtgtacatctacttgtcactttggagaccctggtgatgtcatgggtccaaaagataaaccatttatttgccctgaatttccagggcaattcaggaaaaaatgtaactttgccacaactccagtttgtgaatatgatgggaataccatctcaggctacaagaaagttcttgcaacaattgattcattccaatcatttaacacaagcaatatacacttcactgatgaaagaattgaatggagggaccctgatggtatgcttcgggatcatattaatatcgttatttcaaaagatattgattttgaaaatttggctgagaatccttgtaaagtagggctccaggcagcaaacatagaaggtgcttggggttcaggtgttgggtttacactcacatgccaggtgtctctcacagaatgcccaacatttctcacatcaataaaggcctgtgacatggccatttgttatggtgcagaaagtgtgacactctcacgaggacaaaatactgtcaaaattaccgggaaaggtggccatagtggttcttcatttaaatgctgtcatgggaaagaatgttcatcgactgggcttcaagccagtgcaccacatctggataaggtaaatggtatctctgagttagaaaatgagaaggtttatgatgatggtgcacctgaatgtggcattacttgttggtttaaaaaatcaggtgaatgggttatgggtataatcaatgggaactgggttgtcctaattgttttgtgtgtcttgttgctcttttctcttatcctgttgagcattttgtgtcctgtaagaaagcataaaaaatcataa

SEQ ID NO: 3443 - RNA, 3402 nt, synthetic construct
  misc_feature 1..3402: note = derived and/or modified CDS sequence (wt) from SEOV(80-39)__S47716.1__GP
  source 1..3402: mol_type = other RNA
atgtggagtttgctattactggccgctttagttggccaaggctttgcattaaaaaatgtgtttgacatgagaattcagtgcccccactcagtcaaatttggggaaacaagtgtgtcaggctacacagaactgcccccactctcattacaggaggcagaacagctggtgccagagagctcatgcaacatggacaaccaccaatcactctcaacaataaataaattaaccaaggtcatatggcggaaaaaggcaaatcaggaatcagcaaaccagaattcatttgaacttatggagagtgaagtcagctttaaagggttgtgtatgttaaagcatagaatggttgaagaatcctacagaaataggagatcagtaatctgttatgatctagcctgtaatagtacattctgtaagccaactgtctacatgattgttcctatacatgcatgcaacatgatgaaaagctgtttgattggtcttggtccttacagagtccaggtcgtttatgaaaggacatactgcactacgggtatattgacagaaggaaaatgctttgttcctgacaaggctgtcgtcagtgcattgaagagaggcatgtacgccatagcaagcatagagacaatctgcttttttattcatcagaaagggaatacatataagatagtgactgccatcacatcggcaatgggctccaaatgtaataatacagatactaaagttcaagggtattatatctgtattattggtgggaactctgcccccgtatatgcccctgctggtgaagactttagggcaatggaggttttttccgggattattacatcaccgcatggagaagaccatgatctccctggcgaagaaattgcaacataccagatttcagggcagatagaggcaaaaatccctcatacagtgagctccaagaacttaaaattgactgcttttgcaggtattccatcatactcatcaaccagtatattgactgcttcagaagatggtcgtttcatatttagtcctggtctatttcctaacctaaatcagtcagtctgtgacaacaatgcactccctttaatctggaggggcctaattgatttaacaggatactatgaggcagtccacccttgcaatgtattctgtgtcttatcaggaccaggtgcttcatgtgaagccttttcagaaggaggtattttcaatattacttccccaatgtgtcttgtgtccaagcaaaataggtttagagcagctgagcagcagatcagctttgtttgccaaagggttgatatggatattatagtgtactgtaatggtcagaaaaagacaatcctaacaaaaacattagttataggccaatgcatttatactattacaagtctcttttcactgttaccaggggttgcccattctattgctattgagttgtgtgttccaggatttcatggctgggccacagctgcacttttgatcacattctgctttggctgggtattgattcctgcatgtacattagctattcttttagttcttaagttttttgcaaatatcctccacacaagcaatcaagagaaccgattcaaagccattctacggaaaataaaggaggagtttgaaaaaacaaagggttccatggtttgtgagatctgtaagtacgagtgtgaaacattaaaggaattgaaggcacataatctatcatgtgttcaaggggaatgcccatattgctttacccactgtgaaccgacagaaactgcaattcaggcacattacaaagtttgtcaagccacccaccgattcagagaagatttaaaaaagactgtgactcctcaaaatattgggcctggttgttaccgaacattaaatctttttaggtataaaagtaggtgttatattctgacaatgtggactcttcttctcattattgaatccattctctgggcagcaagtgcagcagaaatcccccttgtccctctctggacagataatgctcatggtgttgggagtgttcctatgcatacagaccttgaattagacttttctttgccatctagttctaggtacacatataaaagacatctcacaaacccagttaatgaccaacagagtgtctcattgcacatagaaattgaaagtcaaggcattggtgctgatgtccatcatcttggacattggtatgatgcaagattgaatttaaaaacctcatttcattgttatggtgcctgcacaaaatatcaatatccatggcacactgcaaaatgccattttgagaaagattatgagtatgaaaatagctgggcatgcaaccccccagattgcccaggggttggtacaggttgtactgcttgtgggttatatctcgatcaattgaagccggtaggaacagcctttaaaattataagtgtaagatacagtagaaaagtgtgcgtgcagtttggtgaagagtacctttgtaaaacaattgatatgaacgattgctttgtgactaggcatgccaaaatatgtataattgggactgtatctaagttttctcaaggtgacactctactatttctggggcccatggaaggaggtggtataatctttaaacactggtgcacgtctacctgtcactttggagaccctggtgatgtcatgggtccaaaggataaaccatttatttgccctgaattcccagggcaattcaggaaaaaatgtaactttgccacaactccagtttgtgaatatgatgggaatattatctcaggctataagaaagttcttgcaacaattgattctttccaatcatttaacacaagcaatatacacttcactgatgagagaattgaatggagagaccctgatggtatgcttcgggatcatattaatatcgttatttctaaagatattgattttgaaaatttggctgagaatccttgtaaagtagggctccaggcagcaaacatagaaggtgcctggggttcaggtgtcgggtttacactcacatgccaggtgtctctcacagaatgcccaacatttctcacgtcaataagggcctgtgacatggcaatttgttatggtgcagaaagtgtgacactctcacgaggacaaaatactgtcaaaattaccgggaaaggtggccatagtggttcctcatttaagtgctgtcatgggaaagaatgttcattaactggcctccaagccagtgcaccacatttagataaggtaaatggaatctctgagttagaaaatgagaaagtttatgatgatggtgcacctgaatgtggcattacttgttggtttaaaaaatcaggtgaatgggttatgggtataatcaatgggaactgggttgtcctaattgtcttgtgtgtcctgctgctcttttctcttatcctgttgagcatcctgtgtcctgttagaaagcataaaaaatcataa

SEQ ID NO: 3444 - RNA, 3402 nt, synthetic construct
  misc_feature 1..3402: note = derived and/or modified CDS sequence (wt) from SEOV(93HBQ3)__KM115585.1__GP
  source 1..3402: mol_type = other RNA
atgtggagtttgctattattggccgctttagttggccaaggctttgcattaaaaaatgtgtttgacatgagaattcagtgtccccactcagtcaaatttggagaaacaagtgtgtcaggctatacagaattgcccccactctcattacaggaggcagaacagctagtgccagagagctcatgcaacatggacaaccaccaatcactctcaacaataaataaattaaccaaggtaatatggcagaaaaaagcaaatcaggaatcagcaaaccagaattcatttgaagttgcagagagtgaagtcagcttcaaagggttgtgcatgttaaagcatagaatggttgaagaatcatatagaaacaggagatcagtaatctgttatgatctagcctgtaatagcacattctgtaagccaactgtttacatgattgttcctatacatgcttgcaacatgatgaaaagctgtttgattggccttggtccctatagaatccaggttgtctatgaaaggacatactgcactacgggtatattgacagaaggaaagtgctttgtccctgacaaggctgttgtcagtgcattgaagagaggcatgtatgccatagcaagcatagagacaatctgcttttttatccatcagaaaggaaatacatataagatagtgactgccattacatcagcaatgggctccaaatgtaataatacagatactaaagttcagggatattatatctgtattattggtggaaactctgcccctgtatatgccccttctggtgaagactttagggcaatggaagttttttctgggattattatgtcaccgcatggagaagaccatgacctccctggcgaagaaatcgcaacataccagatttcagggcagatagaggcaaaaatccctcatacagtgagctccaaaaacttaaaattgactgcttttgcaggtattccatcatactcatcaactagtatattggctgcttcagaagatggtcgcttcatatttagtcctggtttatttcctaacctaaatcagtcagtctgtgataacaatgcacttcctctaatctggaggggcctaattgatttaacgggatactatgaggcagtccacccttgcaatgtattctgtgtcttatcaggaccaggcgcttcatgtgaagccttttcagaaggaggtattttcaatattacttctccaatgtgtctggtgtccaagcaaaataggtttagagcagctgagcagcagatcagctttgtctgccaaagggtcgacatggatattatagtgtactgtaatggtcaaaaaaagacaatcctaacaaaaacattagttataggccaatgtatttatactattacaagtctcttttcactgttaccaggggttgcccattctattgctattgagttgtgtgttccagggtttcatggctgggccacagctgcacttttgatcacattctgctttggctgggtattgattcctgcatgtacattagctattcttctagttcttaagttttttgcaaatatccttcatacaagcaatcaagagaatcgattcaaagctattctacggaaaataaaggaggagtttgaaaaaacaaagggttccatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtttgtcaagccacccaccgattcagagaggatttaaaaaagactgtaactcctcaaaatattggcccaggctgttaccgaacattgaatcttttcaggtataaaagtaggtgttatattctgacaatgtggactcttcttctcattattgaatccatcctctgggcagcaagtgcggcagaaatccccctagtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttggacattggtatgatgcaagattgaatctaaaaacctcatttcattgctacggtgcctgcacaaaataccaatatccatggcatactgcaaaatgccattttgagaaagattatgagtatgagaatagttgggcatgcaaccccccagattgcccaggggttggtacaggttgtactgcttgcggattatacttagatcaattgaagccagtaggaacagccctcaagattataagtgtgagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactatttcttgggcccatggaaggaggtggtataatctttaaacactggtgtacatctacctgtcactttggagaccctggtgatgttatgggtccaaaagataaaccatttatttgccctgaattcccagggcaattcagaaagaaatgtaattttgccacaactccagtttgtgaatatgatgggaacattatttcaggctataagaaagttcttgcgacaattgattctttccaatcatttaacacaagcaatatacacttcactgatgagagaattgaatggagagatcctgatggtatgcttcgggatcatattaatattgttatttctaaagatattgattttgaaaatttggccgagaatccttgtaaagtagggctccaggctgcaaacatagaaggtgcttggggttcaggtgtcgggttcacactcacatgccaggtgtctctcacagaatgcccgacatttcttacgtcaataaaggcctgtgacatggcaatctgttatggtgcagaaagtgtgacactcttacgaggacaaaatactgtcaaaattaccgggaaaggtggccacagtggttcttcatttaaatgctgtcatgggaaagaatgttcatcaactggccttcaagccagtgcaccacacctggataaggtaaatggcatttctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctgctacttttttctcttatcctgttgagcatcttgtgtcctgttagaaagcataaaaaatcataa

SEQ ID NO: 3445 - RNA, 3402 nt, synthetic construct
  misc_feature 1..3402: note = derived and/or modified CDS sequence (wt) from SEOV(93HBQ4)__KM115586.1__GP
  source 1..3402: mol_type = other RNA
atgtggagtttgctattattggccgctttagttggccaaggctttgcattaaaaaatgtgtttgacatgagaattcagtgtcctcactcagtcaactttggagaaacaagtgtgtcaggctatacagaattgcccccactctcattacaggaggcagaacagctagtgccagagagctcatgcaacatggacaaccaccaatcactctcaacaataaataaattaaccaaggtaatatggcggaaaaaagcaaatcaggaatcagcaaaccagaattcatttgaagttgcagagagtgaagtcagcttcaaagggttgtgcatgttaaagcatagaatggttgaagaatcatatagaaacaggagatcagtaatctgttatgatctagcctgtaatagcacattctgtaagccaactgtttacatgattgttcctatacatgcttgcaacatgatgaaaagctgtttgattggccttggtccctatagaatccaggttgtctatgaaaggacatactgcactacgggtatattgacagaaggaaagtgctttgtccctgacaaggctgttgtcagtgcattgaagagaggcatgtatgccatagcaagcatagagacaatctgcttttttatccatcagaaaggaaatacatataagatagtgactgccattacatcagcaatgggctccaaatgtaataatacagatactaaagttcagggatattatatctgtattattggtggaaactctgcccctgtatatgccccttctggtgaagactttagggcaatggaagttttttctgggattattatgtcaccgcatggagaagaccatgacctccctggcgaagaaatcgcaacataccagatttcagggcagatagaggcaaaaatccctcatacagtgagctccaaaaacttaaaattgactgcttttgcaggtattccatcatactcatcaactagtatattagctgcttcaggagatagtcgcttcatatttagtcctggtttatttcctaacctaaatcagtcagtctgtgataacaatgcacttcctttaatctggaggggcctaattgatttaacgggatactatgaggcagtccacccttgcaatgtattctgtgtcttatcaggaccaggcgcttcatgtgaagccttttcagaaggaggtattttcaatattacttctccaatgtgtctggtgtccaagcaaaataggtttagagcagctgagcagcagatcagctttgtctgccaaagggtcgacatggatattatagtgtactgtaatggtcaaaaaaagacaatcctaacaaaaacattagttataggccaatgtatttatactattacaagtctcttttcactgttaccaggggttgcccattctattgctattgagttgtgtgttccagggtttcatggctgggccacagctgcacttttgatcacattctgctttggctgggtattgattcctgcatgtacattagctattcttctagttcttaagttttttgcaaatatccttcatacaagcaatcaagagaatcgattcaaagctattctacggaaaataaaggaggagtttgaaaaaacaaagggttccatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtttgtcaagccacccaccgattcagagaggatttaaaaaagactgtaactcctcaaaatattggcccaggctgttaccgaacattgaatcttttcaggtataaaagtaggtgttatattctgacaatgtggactcttcttctcattattgaatccatcctctgggcagcaagtgcggcagaaatccccctagtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttggacattggtatgatgcaagattgaatctaaaaacctcatttcattgctacggtgcctgcacaaaataccaatatccatggcatactgcaaaatgccattttgagaaagattatgagtatgagaatagttgggcatgcaaccccccagattgcccaggggttggtacaggttgtactgcttgtggattatacctagatcaattgaagccagtaggaacagccttcaagattataagtgtgagatacagtagaaaagtgtgcgtgcagtttggtgaagaatacctttgtaaaacaattgatatgaatgattgctttgtgactaggcatgccaaaatatgtataattgggactgtatctaagttttctcaaggtgatactctactatttcttgggcccatggaaggaggtggtataatctttaaacactggtgtacatctacctgtcactttggagaccctggtgatgttatgggtccaaaagataaaccatttatttgccctgaattcccagggcaattccgaaagaaatgtaattttgccacaactccagtttgtgaatatgatgggaacattatttcaggctataagaaagtacttgcgacaattgattctttccaatcatttaacacaagcaatatacacttcaccgatgagacaattgaatggagagatcctgatggtatgcttcgggatcatattaatattgttatttctaaagatattgattttgaaaatttggccgagaatccttgtaaagtagggctccaggctgcaaacatagaaggtgcttggggttcaggtgtcgggttcacactcacatgccaggtgtctctcacagaatgcccgacatttcttacatcaataaaggcctgtgacatggcaatctgttatggtgcagaaagtgtgacactctcacgaggacaaaatactgtcaaaattaccgggaaaggtggccacagtggttcttcatttaaatgctgtcatgggaaagaatgttcatcaactggtcttcaagccagtgcaccacacctggataaggtaaatggtatttctgagttagaaaacgagagagtttatgatgatggtgcacctgaatgtggcattacttgttggtttaaaaaatcaggtgaatgggttatgggtataatcaatgggaactgggttgtcctgattgttttgtgtgtcctgctacttttttctcttatcctgttgagcatcttgtgtcctgttagaaagcataaaaaatcataa

SEQ ID NO: 3446 - RNA, 3402 nt, synthetic construct
  misc_feature 1..3402: note = derived and/or modified CDS sequence (wt) from SEOV(B1)__AB457790.1__GP
  source 1..3402: mol_type = other RNA
atgtggagtttgctattactggccgctttagttggtcaaggctttgcattaaaaaatgtgtttgacatgagaattcagtgtccccactcagtcaacttcggggaaacaagtgtgtcaggctatacagaactgcccccactctcattacaggaggctgaacagctggtgccagagagctcatgcaacatggacaaccaccaatcactctcaacaataaataaattaaccaaggtcatatggcggaaaaaagcaaatcaggaatcagcaaaccagaattcatttgaagttgtggagagtgaagtcagctttaaagggttgtgtatgttaaagcatagaatggttgaagaatcatatagaaataggagatcagtaatttgttatgatctagcctgtaatagtacattctgtaagccaactgtttacatgatcgttcctatacatgcatgcaacatgatgaaaagctgcttaattggccttggtccatacagaatccaggttgtctatgaaaggacatactgcactacaggtatattgacagaaggaaaatgctttgttcctgacaaggctgttgtcagtgcattgaagagaggcatgtatgccatagcaagcatagagacaatctgcttttttattcatcagaaagggaatacatataagatagtgactgccattacatcggcaatgggctcgaaatgtaataatacagatactaaagttcaaggatattatatctgtattattggtggaaactctgcccctgtatatgcccctgctggtgaagactttagggcaatggaggttttttctgggattattacatcaccgcatggagaagaccatgacctccctggcgaagaaattgcaacataccagatttcagggcagatagaggcaaaaatccctcatacagtgagctccaagaatttaagattgactgcttttgcaggtattccatcatactcatcaactagtatattggctgcttcagaagatggtcgtttcatatttagtcctggtctatttcctaacctaaatcagtcagtctgtgacaacaatgcactccctttaatctggaggggcctaattgatttaacgggatactatgaggcagtccacccttgtaatgtattctgtgtcttatcaggaccaggtgcttcatgtgaagccttttcagaaggaggtattttcaatattacttctccaatgtgcctggtgtccaagcagaataggtttagagcagctgagcagcagatcagctttgtctgccaaagggttgatatggatattatagtgtactgtaatggtcagaaaaaaacaatcttaacaaaaacattagttataggccaatgcatttatactattacaagtctcttttcactgttaccaggggttgcccattctattgctattgagttgtgtgttccagggtttcatggctgggccacagctgcacttttgatcacattctgctttggctggatattgattcctgcatggacattagctattcttttagttcttaagttttttgcaaatatccttcatacaagcaatcaagagaaccgattcaaagccattctacggaaaataaaggaggagtttgaaaaaacaaagggttccatggtttgtgagatctgtaagtatgagtgtgaaacattaaaagaattgaaggcacataatctatcatgtgttcaaggagagtgcccatattgctttacccactgtgaaccgacagaaactgcaatacaggcacattacaaaatttgtcaggccacccaccgattcagagaagatttaaaaaagactgtaactcctcaaaacattgggcctggctgttaccgcacattaaatctttttaggtataagagtaggtgttatattctgacaatgtggactcttcttcttattattgaatccatcctctgggcagcaagtgcagcagaaatcccccttgtccctctctggacagataatgctcatggcgttgggagtgttcctatgcatacagatcttgaattagacttttctttgccatccagttctaagtacacatataaaagacatctcacaaacccagttaatgaccaacagagtgtctcattgcacatagaaattgaaagtcaaggcattggtgctgatgttcatcatcttggacattggtatgatgcaagactgaatctaaaaacctcatttcattgttatggtgcctgcacaaaatatcaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactgttcctagggcctatggaaggaggtggtataatctttaaacactggtgcacatcaacctgtcactttggagaccctggtgatgtcatgggtccaaaagataaaccatttatttgccctgaattcccagggcaattcaggaaaaaatgtaactttgccaccactccagtttgtgaatatgatggaaacattatctcaggctataagaaagttcttgcaacaattgattctttccaatcatttaatacaagtaacatacacttcactgatgagagaattgaatggagagaccctgatggtatgctccgggatcatattaatatcgttatttctaaagatattgattttgaaaatttagctgagaatccttgtaaagtagggcttcaggcagcaaacatagaaggtgcctggggttcaggtgttgggtttacactcacatgtcaggtgtctctcacagaatgcccaacatttctcacatcaataaaggcctgtgacatggcaatttgttatggtgcagaaagtgtaaaactctcacgaggacaaaatactgtcaaaattactgggaaaggtggccatagtggttcttcatttaaatgctgtcatgggaaagaatgttcatcaactggcctccaagccagtgcaccacatctggataaggtaaatggtatctctgagttagaaaacgagaaagtttatgatgatggtgcacctgaatgtggcgttacttgttggtttaaaaaatcaggtgaatgggttatgggtataatcaatggaaactgggttgtcctaattgtcttgtgtctcctgctgctcttttctcttatcctgttgagcatcttgtgtcctgttagaaagcataaaaaatcataa

SEQ ID NO: 3447 - RNA, 3402 nt, synthetic construct
  misc_feature 1..3402: note = derived and/or modified CDS sequence (wt) from SEOV(B1)__AB457791.1__GP
  source 1..3402: mol_type = other RNA
atgtggagtttgctattactggccgctttagttggtcaaggctttgcattaaaaaatgtgtttgacatgagaattcagtgtccccactcagtcaacttcggggaaacaagtgtgtcaggctatacagaactgcccccactctcattacaggaggctgaacagctggtgccagagagctcatgcaacatggacaaccaccaatcactctcaacaataaataaattaaccaaggtcatatggcagaaaaaagcaaatcaggaatcagcaaaccagaattcatttgaagttgtggagagtgaagtcagctttaaagggttgtgtatgttaaagcatagaatggttgaagaatcatatagaaataggagatcagtaatttgttatgatctagcctgtaatagtacattctgtaagccaactgtttacatgatcgttcctatacatgcatgcaacatgatgaaaagctgcttaattggccttggtccatacagaatccaggttgcctatgaaaggacatactgcactacaggtatattgacagaaggaaaatgctttgttcctgacaaggctgttgtcagtgcattgaagagaggcatgtatgccatagcaagcatagagacaatctgcttttttattcatcagaaagggaatacatataagatagtgactgccattacatcggcaatgggctcgaaatgtaataatacagatactaaagttcaaggatattatatctgtattattggtggaaactctgcccctgtatatgcccctgctggtgaagactttagggcaatggaggttttttctgggattattacatcaccgcatggagaagaccatgacctccctggcgaagaaattgcaacataccagatttcagggcagatagaggcaaaaatccctcatacagtgagctccaagaatttaagattgactgcttttgcaggtattccatcatactcatcaactagtatattggctgcttcaaaagatggtcgtttcatatttagtcctggtctatttcctaacctaaatcagtcagtctgtgacaacaatgcactccctttaatctggaggggcctaattgatttaacgggatactatgaggcagtccacccttgtaatgtattctgtgtcttatcaggaccaggtgcttcatgtgaagccttttcagaaggaggtattttcaatattacttctccaatgtgcctggtgtccaagcagaataggtttagagcagctgagcagcagatcagctttgtctgccaaagggttgatatggatattatagtgtactgtaatggtcagaaaaaaacaatcttaacaaaaacattagttataggccaatgcatttatactattacaagtctcttttcactgttaccaggggttgcccattctattgctattgagttgtgtgttccagggtttcatggctgggccacagctgcacttttgatcacattctgctttggctggatattgattcctgcatgtacattagctattcttttagttcttaagttttttgcaaatatccttcatacaagcaatcaagagaaccgattcaaagccattctacggaaaataaaggaggagtttgaaaaaacaaagggttccatggtttgtgagatctgtaagtatgagtgtgaaacattaaaagaattgaaggcacataatctatcatgtgttcaaggagagtgcccatattgctttacccactgtgaaccgacagaaactgcaatacaggcacattacaaaatttgtcaggccacccaccgattcagagaagatttaaaaaagactgtaactcctcaaaacattgggcctggctgttaccgcacattaaatctttttaggtataagagtaggtgttatattctgacaatgtggactcttcttcttattattgaatccatcctctgggcagcaagtgcagcagaaatcccccttgtccctctctggacagataatgctcatggcgttgggagtgttcctatgcatacagatcttgaattagacttttctttgccatccagttctaagtacacatataaaagacatctcacaaacccagttaatgaccaacagagtgtctcattgcacatagaaattgaaagtcaaggcattggtgctgatgttcatcatcttggacattggtatgatgcaagactgaatctaaaaacctcatttcattgttatggtgcctgcacaaaatatcaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactgttcctagggcctatggaaggaggtggtataatctttaaacactggtgcacatcaacctgtcactttggagaccctggtgatgtcatgggtccaaaagataaaccatttatttgccctgaattcccagggcaattcaggaaaaaatgtaactttgccaccactccagtttgtgaatatgatggaaacattatctcaggctataagaaagttcttgcaacaattgattctttccaatcatttaatacaagtaacatacacttcactgatgagagaattgaatggagagaccctgatggtatgctccgggatcatattaatatcgttatttctaaagatattgattttgaaaatttagctgagaatccttgtaaagtagggcttcaggcagcaaacatagaaggtgcctggggttcaggtgttgggtttacactcacatgtcaggtgtctctcacagaatgcccaacatttctcacatcaataaaggcctgtgacatggcaatttgttatggtgcagaaagtgtaacactctcacgaggacaaaatactgtcaaaattactgggaaaggtggccatagtggttcttcatttaaatgctgtcatgggaaagaatgttcatcaactggcctccaagccagtgcaccacatctggataaggtaaatggtatctctgagttagaaaacgagaaagtttatgatgatggtgcacctgaatgtggcgttacttgttggtttaaaaaatcaggtgaatgggttatgggtataatcaatggaaactgggttgtcctaattgtcttgtgtctcctgctgctcttttctcttatcctgttgagcatcttgtgtcctattagaaagcataaaaaatcataa

SEQ ID NO: 3448 - RNA, 3402 nt, synthetic construct
  misc_feature 1..3402: note = derived and/or modified CDS sequence (wt) from SEOV(B1)__AB457792.1__GP
  source 1..3402: mol_type = other RNA
atgtggagtttgctattaatggccgctttagttggtcaaggctttgcattaaaaaatgtgtttgacatgagaattcagtgtccccactcagtcaacttcggggaaacaagtgtgtcaggctatacagaactgcccccactctcattacaggaggctgaacagctggtgccagagagctcatgcaacatggacaaccaccaatcactctcaacaataaataaattaaccaaggtcatatggcagaaaaaagcaaatcaggaatcagcaaaccagaattcatttgaagttgtggagagtgaagtcagctttaaagggttgtgtatgttaaagcatagaatggttgaagaatcatatagaaataggagatcagtaatttgttatgatctagcctgtaatagtacattctgtaagccaactgtttacatgatcgttcctatacatgcatgcaacatgatgaaaagctgcttaattggccttggtccatacagaatccaggttgcctatgaaaggacatactgcactacaggtatattgacagaaggaaaatgctttgttcctgacaaggctgttgtcagtgcattgaagagaggcatgtatgccatagcaagcatagagacaatctgcttttttattcatcagaaagggaatacatataagatagtgactgccattacatcggcaatgggctcgaaatgtaataatacagatactaaagttcaaggatattatatctgtattattggtggaaactctgcccctgtatatgcccctgctggtgaagactttagggcaatggaggttttttctgggattattacatcaccgcatggagaagaccatgacctccctggcgaagaaattgcaacataccagatttcagggcagatagaggcaaaaatccctcatacagtgagctccaagaatttaagattgactgcttttgcaggtattccatcatactcatcaactagtatattggctgcttcaaaagatggtcgtttcatatttagtcctggtctatttcctaacctaaatcagtcagtctgtgacaacaatgcactccctttaatctggaggggcctaattgatttaacgggatactatgaggcagtccacccttgtaatgtattctgtgtcttatcaggaccaggtgcttcatgtgaagccttttcagaaggaggtattttcaatattacttctccaatgtgcctggtgtccaagcagaataggtttagagcagctgagcagcagatcagctttgtctgccaaagggttgatatggatattatagtgtactgtaatggtcagaaaaaaacaatcttaacaaaaacattagttataggccaatgcatttatactattacaagtctcttttcactgttaccaggggttgcccattctattgctattgagttgtgtgttccagggtttcatggctgggccacagctgcacttttgatcacattctgctttggctggatattgattcctgcatgtacattagctattcttttagttcttaagttttttgcaaatatccttcatacaagcaatcaagagaaccgattcaaagccattctacggaaaataaaggaggagtttgaaaaaacaaagggttccatggtttgtgagatctgtaagtatgagtgtgaaacattaaaagaattgaaggcacataatctatcatgtgttcaaggagagtgcccatattgctttacccactgtgaaccgacagaaactgcaatacaggcacattacaaaatttgtcaggccacccaccgattcagagaagatttaaaaaagactgtaactcctcaaaacattgggcctggctgttaccgcacattaaatctttttaggtataagagtaggtgttatattctgacaatgtggactcttcttcttattattgaatccatcctctgggcagcaagtgcagcagaaatcccccttgtccctctctggacagataatgctcatggcgttgggagtgttcctatgcatacagatcttgaattagacttttctttgccatccagttctaagtacacatataaaagacatctcacaaacccagttaatgaccaacagagtgtctcattgcacatagaaattgaaagtcaaggcattggtgctgatgttcatcatcttggacattggtatgatgcaagactgaatctaaaaacctcatttcattgttatggtgcctgcacaaaatatcaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactgttcctagggcctatggaaggaggtggtataatctttaaacactggtgcacatcaacctgtcactttggagaccctggtgatgtcatgggtccaaaagataaaccatttatttgccctgaattcccagggcaattcaggaaaaaatgtaactttgccaccactccagtttgtgaatatgatggaaacattatctcaggctataagaaagttcttgcaacaattgattctttccaatcatttaatacaagtaacatacacttcactgatgagagaattgaatggagagaccctgatggtatgctccgggatcatattaatatcgttatttctaaagatattgattttgaaaatttagctgagaatccttgtaaagtagggcttcaggcagcaaacatagaaggtgcctggggttcaggtgttgggtttacactcacatgtcaggtgtctctcacagaatgcccaacatttctcacatcaataaaggcctgtgacatggcaatttgttatggtgcagaaagtgtaacactctcacgaggacaaaatactgtcaaaattactgggaaaggtggccatagtggttcttcatttaaatgctgtcatgggaaagaatgttcatcaactggcctccaagccagtgcaccacatctggataaggtaaatggtatctctgagttagaaaacgagaaagtttatgatgatggtgcacctgaatgtggcgttacttgttggtttaaaaaatcaggtgaatgggttatgggtataatcaatggaaactgggttgtcctaattgtcttgtgtctcctgctgctcttttctcttatcctgttgagcatcttgtgtcctattagaaagcataaaaaatcataa

SEQ ID NO: 3449 - RNA, 3402 nt, synthetic construct
  misc_feature 1..3402: note = derived and/or modified CDS sequence (wt) from SEOV(B1)__AB457793.1__GP
  source 1..3402: mol_type = other RNA
atgtggagtttgctattactggccgctttagttggtcaaggctttgcattaaaaaatgtgtttgacatgagaattcagtgtccccactcagtcaacttcggggaaacaagtgtgtcaggctatacagaactgcccccactctcattacaggaggctgaacagctggtgccagagagctcatgcaacatggacaaccaccaatcactctcaacaataaataaattaaccaaggtcatatggcagaaaaaagcaaatcaggaatcagcaaaccagaattcatttgaagttgtggagagtgaagtcagctttaaagggttgtgtatgttaaagcatagaatggttgaagaatcatatagaaataggagatcagtaatttgttatgatctagcctgtaatagtacattctgtaagccaactgtttacatgatcgttcctatacatgcatgcaacatgatgaaaagctgcttaattggccttggtccatacagaatccaggttgcctatgaaaggacatactgcactacaggtatattgacagaaggaaaatgctttgttcctgacaaggctgttgtcagtgcattgaagagaggcatgtatgccatagcaagcatagagacaatctgcttttttattcatcagaaagggaatacatataagatagtgactgccattacatcggcaatgggctcgaaatgtaataatacagatactaaagttcaaggatattatatctgtattattggtggaaactctgcccctgtatatgcccctgctggtgaagactttagggcaatggaggttttttctgggattattacatcaccgcatggagaagaccatgacctccctggcgaagaaattgcaacataccagatttcagggcagatagaggcaaaaatccctcatacagtgagctccaagaatttaagattgactgcttttgcaggtattccatcatactcatcaactagtatattggctgcttcaaaagatggtcatttcatatttagtcctggtctatttcctaacctaaatcagtcagtctgtgacaacaatgcactccctttaatctggaggggcctaattgatttaacgggatactatgaggcagtccacccttgtaatgtattctgtgtcttatcaggaccaggtgcttcatgtgaagccttttcagaaggaggtattttcaatattacttctccaatgtgcctggtgtccaagcagaataggtttagagcagctgagcagcagatcagctttgtctgccaaagggttgatatggatattatagtgtactgtaatggtcagaaaaaaacaatcttaacaaaaacattagttataggccaatgcatttatactattacaagtctcttttcactgttaccaggggttgcccattctattgctattgagttgtgtgttccagggtttcatggctgggccacagctgcacttttgatcacattctgctttggctggatattgattcctgcatgtacattagctattcttttagttcttaagttttttgcaaatatccttcatacaagcaatcaagagaaccgattcaaagccattctacggaaaataaaggaggagtttgaaaaaacaaagggttccatggtttgtgagatctgtaagtatgagtgtgaaacattaaaagaattgaaggcacataatctatcatgtgttcaaggagagtgcccatattgctttacccactgtgaaccgacagaaactgcaatacaggcacattacaaaatttgtcaggccacccaccgattcagagaagatttaaaaaagactgtaactcctcaaaacattgggcctggctgttaccgcacattaaatctttttaggtataagagtaggtgttatattctgacaatgtggactcttcttcttattattgaatccatcctctgggcagcaagtgcagcagaaatcccccttgtccctctctggacagataatgctcatggcgttgggagtgttcctatgcatacagatcttgaattagacttttctttgccatccagttctaagtacacatataaaagacatctcacaaacccagttaatgaccaacagagtgtctcattgcacatagaaattgaaagtcaaggcattggtgctgatgttcatcatcttggacattggtatgatgcaagactgaatctaaaaacctcatttcattgttatggtgcctgcacaaaatatcaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactgttcctagggcctatggaaggaggtggtataatctttaaacactggtgcacatcaacctgtcactttggagaccctggtgatgtcatgggtccaaaagataaaccatttatttgccctgaattcccagggcaattcaggaaaaaatgtaactttgccaccactccagtttgtgaatatgatggaaacattatctcaggctataagaaagttcttgcaacaattgattctttccaatcatttaatacaagtaacatacacttcactgatgagagaattgaatggagagaccctgatggtatgctccgggatcatattaatatcgttatttctaaagatattgattttgaaaatttagctgagaatccttgtaaagtagggcttcaggcagcaaacatagaaggtgcctggggttcaggtgttgggtttacactcacatgtcaggtgtctctcacagaatgcccaacatttctcacatcaataaaggcctgtgacatggcaatttgttatggtgcagaaagtgtaacactctcacgaggacaaaatactgtcaaaattactgggaaaggtggccatagtggttcttcatttaaatgctgtcatgggaaagaatgttcatcaactggcctccaagccagtgcaccacatctggataaggtaaatggtatctctgagttagaaaacgagaaagtttatgatgatggtgcacctgaatgtggcgttacttgttggtttaaaaaatcaggtgaatgggttatgggtataatcaatggaaactgggttgtcctaattgtcttgtgtctcctgctgctcttttctcttatcctgttgagcatcttgtgtcctattagaaagcataaaaaatcataa

SEQ ID NO: 3450 - RNA, 3402 nt, synthetic construct
  misc_feature 1..3402: note = derived and/or modified CDS sequence (wt) from SEOV(B1)__AB457794.1__GP
  source 1..3402: mol_type = other RNA
atgtggagtttgctattaatggccgctttagttggtcaaggctttgcattaaaaaatgtgtttgacatgagaattcagtgtccccactcagtcaacttcggggaaacaagtgtgtcaggctatacagaactgcccccactctcattacaggaggctgaacagctggtgccagagagctcatgcaacatggacaaccaccaatcactctcaacaataaataaattaaccaaggtcatatggcagaaaaaagcaaatcaggaatcagcaaaccagaattcatttgaagttgtggagagtgaagtcagctttaaagggttgtgtatgttaaagcatagaatggttgaagaatcatatagaaataggagatcagtaatttgttatgatctagcctgtaatagtacattctgtaagccaactgtttacatgatcgttcctatacatgcatgcaacatgatgaaaagctgcttaattggccttggtccatacagaatccaggttgcctatgaaaggacatactgcactacaggtatattgacagaaggaaaatgctttgttcctgacaaggctgttgtcagtgcattgaagagaggcatgtatgccatagcaagcatagagacaatctgcttttttattcatcagaaagggaatacatataagatagtgactgccattacatcggcaatgggctcgaaatgtaataatacagatactaaagttcaaggatattatatctgtattattggtggaaactctgcccctgtatatgcccctgctggtgaagactttagggcaatggaggttttttctgggattattacatcaccgcatggagaagaccatgacctccctggcgaagaaattgcaacataccagatttcagggcagatagaggcaaaaatccctcatacagtgagctccaagaatttaagattgactgcttttgcaggtattccatcatactcatcaactagtatattggctgcttcaaaagatggtcatttcatatttagtcctggtctatttcctaacctaaatcagtcagtctgtgacaacaatgcactccctttaatctggaggggcctaattgatttaacgggatactatgaggcagtccacccttgtaatgtattctgtgtcttatcaggaccaggtgcttcatgtgaagccttttcagaaggaggtattttcaatattacttctccaatgtgcctggtgtccaagcagaataggtttagagcagctgagcagcagatcagctttgtctgccaaagggttgatatggatattatagtgtactgtaatggtcagaaaaaaacaatcttaacaaaaacattagttataggccaatgcatttatactattacaagtctcttttcactgttaccaggggttgcccattctattgctattgagttgtgtgttccagggtttcatggctgggccacagctgcacttttgatcacattctgctttggctggatattgattcctgcatgtacattagctattcttttagttcttaagttttttgcaaatatccttcatacaagcaatcaagagaaccgattcaaagccattctacggaaaataaaggaggagtttgaaaaaacaaagggttccatggtttgtgagatctgtaagtatgagtgtgaaacattaaaagaattgaaggcacataatctatcatgtgttcaaggagagtgcccatattgctttacccactgtgaaccgacagaaactgcaatacaggcacattacaaaatttgtcaggccacccaccgattcagagaagatttaaaaaagactgtaactcctcaaaacattgggcctggctgttaccgcacattaaatctttttaggtataagagtaggtgttatattctgacaatgtggactcttcttcttattattgaatccatcctctgggcagcaagtgcagcagaaatcccccttgtccctctctggacagataatgctcatggcgttgggagtgttcctatgcatacagatcttgaattagacttttctttgccatccagttctaagtacacatataaaagacatctcacaaacccagttaatgaccaacagagtgtctcattgcacatagaaattgaaagtcaaggcattggtgctgatgttcatcatcttggacattggtatgatgcaagactgaatctaaaaacctcatttcattgttatggtgcctgcacaaaatatcaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactgttcctagggcctatggaaggaggtggtataatctttaaacactggtgcacatcaacctgtcactttggagaccctggtgatgtcatgggtccaaaagataaaccatttatttgccctgaattcccagggcaattcaggaaaaaatgtaactttgccaccactccagtttgtgaatatgatggaaacattatctcaggctataagaaagttcttgcaacaattgattctttccaatcatttaatacaagtaacatacacttcactgatgagagaattgaatggagagaccctgatggtatgctccgggatcatattaatatcgttatttctaaagatattgattttgaaaatttagctgagaatccttgtaaagtagggcttcaggcagcaaacatagaaggtgcctggggttcaggtgttgggtttacactcacatgtcaggtgtctctcacagaatgcccaacatttctcacatcaataaaggcctgtgacatggcaatttgttatggtgcagaaagtgtaacactctcacgaggacaaaatactgtcaaaattactgggaaaggtggccatagtggttcttcatttaaatgctgtcatgggaaagaatgttcatcaactggcctccaagccagtgcaccacatctggataaggtaaatggtatctctgagttagaaaacgagaaagtttatgatgatggtgcacctgaatgtggcgttacttgttggtttaaaaaatcaggtgaatgggttatgggtataatcaatggaaactgggttgtcctaattgtcttgtgtctcctgctgctcttttctcttatcctgttgagcatcttgtgtcctattagaaagcataaaaaatcataa

SEQ ID NO: 3451 - RNA, 3402 nt, synthetic construct
  misc_feature 1..3402: note = derived and/or modified CDS sequence (wt) from SEOV(B-1)__X53861.1__GP
  source 1..3402: mol_type = other RNA
atgtggagtttgctattactggccgctttagttggtcaaggctttgcattaaaaaatgtgtttgacatgagaattcagtgtccccactcagtcaacttcggggaaacaagtgtgtcaggctatacagaactgcccccactctcattacaggaggctgaacagctggtgccagagagctcatgcaacatggacaaccaccaatcactctcaacaataaataaattaaccaaggtcatatggcggaaaaaagcaaatcaggaatcagcaaaccagaattcatttgaagttgtggagagtgaagtcagctttaaagggttgtgtatgttaaagcatagaatggttgaagaatcatatagaaataggagatcagtaatctattatgatctagctggtaatagtacattctgtaagccaactgtttacatgatcgttcctatacatgcatgcaacatgatgaaaagctgcttaattggccttggtccctacagaatccaggttgtctatgaaaggacatactgcactacaggtatattgacagaaggaaaatgctttgttcctgacaaggctgttgtcagtgcattgaagagaggcatgtatgccatagcaagcatagagacaatctgcttttttattcatcagaaatggaataaatataagatagtgactgccattacatcggcaatgggctcgaaatgtaataatacagatactaaagttcaaggatattatatctgtattattggtggaaactctgcccctgtatatgcccctgctggtgaagactttagggcaatggaggttttttctgggattattacatcaccacatggagaagaccatgacctccctggcgaagaaattgcaacataccatatttcagggcagatagaggcaaaaatccctcatacagtgagctccaagaacttaagattggctgcttttgcaggtattccatcatactcatcaactagtatattggctgcttcagaagatggtcgtttcatatttagtcctggtctatttcctaacctaaatcagtcagtctgtgacaacaatgcactccctttaatctggaggggcctaattgatttaactggatactatgaggcagtccacccttgtaatgtattctgtgtcttatcaggaccaggtgcttcatgtgaagccttttcagaaggaggtattttcaatattacttctccaatgtgcctggtgtccaagcagaataggtttagagcagctgagcagcagatcagctttgtctgccaaagggttgatatggatattatagtgtactgtaatggtcagaaaaaaacaatcttaacaaaaacattagttataggccaatgcatttatactattacaagtctcttttcactgttaccaggggttgcccattctattgctattgagttgtgtgttccagggtttcatggctgggccacagctgcacttttgatcacattctgctttggctgggtattgattcctgcatgtacattagctattcttttagttcttaagttttttgcaaatatccttcatacaagcaatcaagagaaccgattcaaagccattctacggaaaataaaggaggagtttgaaaaaagaaagggttccatggtttgtgagatctgtaagtatgagtgtgaaacattaaaagaattgaaggcacataatctatcatgtgttcaaggagagtgcccatattgctttacccactgtgaaccgacagaaactgcaattcaggcacattacaaagtttgtcaggccacccaccgattcagagaagatttaaaaaagactgtaactcctcaaaacattgggcctggctgttaccgcacattaaatctttttaggtataagagtaggtgttatattctgacaatgtggactcttcttctaattattgaatccatcctctgggcagcaagtgcagcagaaatcccccttgtcccgctctggacagataatgctcatggcgttgggagtgttcctatgcatacagatcttgaattagacttttctttgccatccagttctaagtacacatataaaagacatctcacaaacccagttaatgaccaacagagtgtctcattgcacatagaaattgaaagtcaaggcattggtgctgatgttcatcatcttggacattggtatgatgcaagactgaatctaaaaacctcatttcattgttatggtgcctgcacaaaatatcaatatccatggcacactgcaaaatgccattttgagaaagattatgagtatgaaaatagctgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaacacctttgtaaaacaattgatatgaatgattgctttgtgactaggcatgccaaaatatgtataattgggactgtatctaagttttctcaaggtgacactctactgttcctagggcctatggaaggaggtggtataatctttaaacactggtgcacatcaacctgtcattttggagaccctcgtgatgtcatgggtccaaaagataaaccatttatttgccctgaattcccagggcaattcaggaaaaaatgtaactttgccacgactccagtttgtgaatatgatggaaacattatctcaggttataagaaagttcttgcaacaattgattctttccaatcatttaatacaagcaacatacacttcactgatgagagaattgaatggagagaccctgatggtatgctccgggatcatattaatattgttatttctaaagatattgattttgaaaatttggctgagaatccttgtaaagtagggcttcaggcagcaaacatagaaggtgcctggggttcaggtgtcgggtttacactcacatgtcaggtgtctctcacagaatgcccaacatttctcacatcaataaaggcctgtgacatggcaatttgttacggtgcagaaagtgtaacactctcacgaggacaaaatactgtcaaaattactgggaaaggtggccatagtggttcttcatttaaatgctgtcatgggaaagaatgttcatcaactggcctccaagccagtgcaccacatctggataaggtaaatggtatctctgagttagaaaacgagaaagtttatgatgatggtgcacctgaatgtggcgttacttgttggtttaaaaaatcaggtgaatgggttatgggtataatcaatggaaactgggttgtcctaattgtcttgtgtgtcctgctgctcttttctcttatcctgttgagcatcttgtgtcctgttagaaagcataaaaaatcataa

SEQ ID NO: 3452 - RNA, 3402 nt, synthetic construct
  misc_feature 1..3402: note = derived and/or modified CDS sequence (wt) from SEOV(BjHD01)__DQ133505.1__GP
  source 1..3402: mol_type = other RNA
atgtggagtttgctattcttggccgctttagttggtcagggctttgcattaaaaaatgtgtttgacatgagaattcagtgtccccattcagtcaactttggggaaacaagtgtgtcaggctatacagaattgcccccactctcattacaggaggcagaacagctagtgccagagagctcatgcaacatggataaccaccaatcactctcaacaataaataaattaactaaggtaatatggcgaaaaaaagcaaatcaggaatcagcaaaccaaaattcatttgaagttgtggagagtgaagtcagctttaaagggttgtgtatgttaaagcatagaatggttgaagaatcatatagaaacaggagatcagtaatctgttatgatctagcctgtaacagtacattctgtaagccaactgtttacatgattgttcctatacatgcttgcaacatgatgaaaagctgtttgattggccttggtccctacagaatccaggttgtttacgaaaggacatactgcactacgggtatattaacagaaggaaagtgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcagggatattatatttgtattattggtggaaactctgcccctgtatatgcccctgctggtgaagattttagggcaatggaggttttttctgggattattacatcaccacatggggaagaccatgacctccctggcgaagaagttgcaacataccagatttcagggcagatagaggcaaaaatccctcatacagtgagctctaaaaacttaaaattgactgcttttgcaggtatcccatcatactcatcaactagtatattagctgcttcagaagatggtcgtttcatatttagtcctggtttatttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttctccaatgtgtctggtgtccaagcaaaacaggttcagagcagctgagcagcagatcagctttgtctgccaaagggtcgatatggatattatagtgtactgtaatggtcaaaaaaagacaatcctaacaaaaacattagttataggccaatgtatttatactattacaagtcttttttcactgttgccaggggttgcccattctattgctattgagttgtgtgtcccagggtttcatggctgggccacagctgcacttttgatcacattctgcttcggctgggtattgatccctgcatgtacattagctattcttctagttctcaagttttttgcaaatatccttcatacaagcaatcaagagaatcgattcaaagccattctacggaaaataaaggaggagtttgaaaaaacaaaaggttccatggtttgtgagatctgtaagtacgagtgtgaaacattaaaggaattgaaggcacataatctatcatgtgttcagggagagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcgtgtggattatatctagatcaattgaagccagtaggaacagcctttaaaattataagtgtaagatacagtagaaaagtgtgcgtgcagtttggtgaagaatacctttgcaaaacaattgatatgaatgattgctttgtgactagacatgccaaaatatgtattattggaactgtatctaagttctctcaaggtgacactctactatttcttgggcccatggaaggaggtggtataatctttaagcactggtgtacgtctacctgtcacttcggagaccctggtgatgttatgggtccaaaagataaaccatttatttgccctgaattcccagggcaattcaggaagaaatgtaattttgccacaactccagtttgtgaatatgatgggaacattatttcaggctataagaaagttcttgcaacaattgattctttccaatcgtttaacacaagcaatatacacttcactgatgagagaattgaatggagagaccctgatggtatgcttcgggatcatatcaatattgttatttctaaagatattgattttgaaaatttggccgagaatccttgtaaagtagggctccaggcagcaaacatagaaggtgcttggggttcaggtgtcgggtttacactcacatgccaggtgtctctcacagaatgcccaacgtttctcacgtcaataaaggcctgtgacatggcaatttgttatggtgcagaaagtgtgacactctcacgaggacaaaatactgtcaaaattaccgggaaaggtggccatagtggttcttcatttaaatgctgtcatggggaagaatgttcatcaactggccttcaagccagtgcaccacatctggataaagtaaatggtatctctgaattagaaaacgagaaagtttatgatgatggtgcacctgaatgtggcgttacttgttggtttaaaaaatcaggtgaatgggttatgggtataatcaatgggaactgggttgtcttaattgttttgtgtgtcctgctgctcttctctcttatcctgttgagcattttgtgtcctgttagaaagcataaaaaatcataa

SEQ ID NO: 3453 - RNA, 3402 nt, synthetic construct
  misc_feature 1..3402: note = derived and/or modified CDS sequence (wt) from SEOV(Cherwell)__KM948593.1__GP
  source 1..3402: mol_type = other RNA
atgtggagtttgctattactggccgctttggttggccaaggctctgcattaaaaaatgtgtttgacatgagaatccagtgtccccactcagttaactttggggaaacaagcgtgtcaggctatacggaactgccaccactctcattacaagaggcagaacagctagtgccagagagctcatgcaacatggacaaccaccaatcactctcaacgataaataaattgaccaaggttatatggcgaaagaaagcaaatcaggaatcagcaaatcagaattcatttgaagttgtggagagtgaagttagctttaaagggttgtgtatgttaaagcatagaatggttgaagaatcatatagaaacaggagatcagtgatctgttatgatttagcctgtaatagtacattctgtaaaccaaccgtttacatgattgttcctatacatgcttgcaacatgatgaaaagctgtttgattggccttggtccctatagaatccaggttgtctacgaaaggacatactgtactacaggtatattgacagaaggaaaatgctttgttcctgacaaggctgttgttagtgcattgaaaaggggcatgtatgccatagcaagcatagagacaatctgcttttttattcatcagaaagggaatacatataagatagtgactgccattacatcggcaatgggctccaaatgtaataatacagatactaaagttcaaggatattatatctgtattattggtggaaactctgcccccgtatatgcccctgctggtgaagactttagggcaatggaggttttttctgggattattacatcaccacatggagaagaccatgatctccctggcgaagaaattgcaacataccagatttcagggcagatagaggcaaaaatccctcatacagtgagctctaaaaacttaaaattgactgcttttgcaggtattccatcttactcatcaaccagcatactggctgcttcagaagatggtcgtttcatatttagtcctggtctatttcctaaccttaatcagtcagtctgtgacaacaatgcactccctttaatctggaggggtctaattgatttaacaggatactatgaggcagtccacccctgcaatgtattctgtgtcttatcaggaccaggtgcttcatgtgaagccttttcagagggaggtatttttaatattacttctccaatgtgtctggtgtctaaacaaaataggtttagagcagccgagcagcagatcagctttgtttgccaaagggttgatatggatattatagtgtactgtaatggtcaaaaaaagacaatcctaacaaaaacattagttataggccaatgtatttatactattacaagtctcttttcactgttaccaggggttgcacattctattgcgattgagttgtgtgttccagggtttcatggatgggccacagctgcacttttgatcacattctgttttggctgggtattgattcctgcatgtacattagctattcttttagtcctcaagttttttgcaaacatccttcatacaagcaatcaagaaaaccgattcaaagccattttacggaaaataaaggaggagtttgaaaaaacaaagggttccatggtctgcgagatctgtaagtacgagtgtgaaacattaaaggagttgaaagcacataacctatcatgtgttcaaggggaatgcccatattgctttactcactgtgaaccaacagaaactgcaattcaggcacattataaagtttgtcaagccacccatcgattcagagaagatttaaaaaagactgtaactcctccaaatattgggccaggctgttatcgaacactaaatcttttcaggtataaaagtagatgttatattctgacaatgtggactcttcttctcattattgaatccatcctctgggcagcaagtgcagcagaaattccccttgtccctctctggacagataatgctcatggcgttgggagtgttcctatgcatacagatcttgaattagacttttctttgccatctagctctaagtatacatataaaagacatctcacaaacccagttaatgaccaacagagtgtttcattgcatatagaaattgaaagccaaggcattggtgctgatgttcatcaccttggacattggtatgatgcaagattaaatctaaaaacctcatttcattgttatggtgcctgcacaaaatatcaatatccatggcacactgcaaaatgtcattttgagaaagattatgagtatgaaaacagctgggcttgcaaccccccagattgcccaggggttggcacaggttgtactgcttgtggagtatatctagatcaactaaagccggtaggaacagccttcaaaattgtaagtgtgagatacagcagaaaagtgtgtgtgcagtttggtgaagaatacctttgtaaaacgattgatatgaacgattgctttgtgactaggcatgccaaaatatgtataattgggactgtatccaagttttctcaaggtgacactctactatttcttgggcccatggaaggaggtggtataatctttaaacactggtgtacttctacctgtcactttggagaccctggtgatgttatgggtccaaaagataaaccctttatttgccctgaattcccaggacaattcaggaaaaaatgtaactttgccacaactccggtttgtgaatatgatgggaacattatttcaggatataaaaaagttcttgcaacaattgattctttccaatcatttaacacaagcaatatacactttactgatgagagaattgaatggagagaccctgatggtatgcttcgggatcatatcaatatcgttatttctaaagatattgattttgaaaatttggctgagaatccttgtaaagtagggctccaggcagcaaacatagaaggtgcctggggttcaggtgttgggtttacacttacatgccaggtgtctctcacagaatgcccaacgtttctcacgtcaattaaggcttgtgacatggcaatctgctatggtgcagaaagtgtaacactctcacgaggacaaaatactgtcaagattactggaaaaggtggccatagtggttcttcatttaaatgttgccacggaaaagaatgttcatcaactggcctccaagccagcgcaccgcatctagataaagtaaacggtatctctgaattagaaaatgagaaagtttatgatgatggtgcacctgaatgtggcgttacttgttggtttaaaaaatcaagtgaatgggtcatgggtataatcaatggaaactgggttgtcctaattgttttgtgtgtcttattactcttctctcttatcctgttgagcattttatgtcctgttaggaagcataaaaaatcataa

SEQ ID NO: 3454 - RNA, 3402 nt, synthetic construct
  misc_feature 1..3402: note = derived and/or modified CDS sequence (wt) from SEOV(HaixingRn40)__GU592924.1__GP
  source 1..3402: mol_type = other RNA
atgtggagtttgctattcttggccgctttagttggccaaggctttgcattaaaaaatgtgtttgacatgagaattcagtgtccccactcagtcaactttggagaaacaagtgtgtcaggctatacagaattgcccccactctcattacaggaggcagaacagctggtgccagagagctcatgtaacatggacaaccaccaatcactctcaacaataaataaactaactaaggtaatatggcggaaaaaagcaaatcaggaatcagcaaaccagaattcatttgaagttgtggagagtgaagtcagctttaaagggttgtgtatgttaaagcatagaatggttgaggaatcatatagaaacaggagatcagtaatctgttacgatctagcctgtaatagtacattctgtaagccaactgtttacatgattgttcctatacatgcttgtaacatgatgaaaagctgtttgattggcctcggtccctacagaattcaggttgtctacgaaaggacatactgcactacgggtatattgacagaaggaaagtgctttgtcccagacaaggctgttgtcagtgcattaaagagaggcatgtatgccatagcaagcatagagacaatctgcttttttattcatcagaaagggaatacatataagatagtgactgccattacatcagcaatgggctccaaatgtaataatacagatactaaagttcagggatattatatctgtattattggtggaaactctgcccctgtatatgcccctgctggtgaagattttagggcgatggaggttttttctgggattattacatcgccgcatggagaagaccatgaccttcctggcgaagaaatcgcaacataccagatttcagggcagatagaggcaaaaatccctcatacagtgagctctaaaaacttaaaattgactgcttttgcaggtattccatcatactcatcaactagtatattagctgcttcagaagatggtcgtttcatatttagtcctggtttgtttcctaacctaaatcagtcagtctgtgacaacaatgcactccctttaatttggaggggcctaattgatttaacgggatactatgaggcagtccacccttgcaatgtattctgtgtcttatcaggaccaggtgcttcatgtgaagccttttcagaaggaggtattttcaatattacttctccgatgtgtctggtgtccaagcaaaataggtttagagcagctgagcagcagatcagctttgtttgccaaagggttgatatggatatcatagtgtactgtaatggtcaaaaaaagacaatcctaacaagaacattagttataggccaatgtatttatactattacaagtctcttttcactgctgccaggggttgcccattctattgctattgagttgtgtgttccagggtttcatggctgggccacagctgcacttttgatcacattctgctttggctgggtattgattcctgcatgtacattagctatccttctagttctcaagttttttgcaaatatcctccatacaagcaatcaagagaatcgattcaaagccattctacggaaaataaaggaggagtttgaaaaaacaaagggttccatggtttgtgaaatctgtaagtatgagtgtgaaacattaaaggaattgaaggcacataatctatcatgtgttcaaggggagtgcccatattgctttacccactgtgaaccaacagaaactgcaattcaggcacattacaaagtttgtcaagccacccaccgattcagagaagatttaaaaaagactgtaactcctcaaaatattgggccaggctgttaccgaacattgaaccttttcaggtataaaagtaggtgttatattctgacaatgtggactcttcttctcattattgaatccatcctctgggcagcaagtgcagcagaaatcccccttgtcccactctggacagataatgctcatggcgttgggagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaatctaaaaacctcatttcattgctatggtgcctgcacaaaataccaatatccatggcatactgcaaaatgccattttgagaaagattatgagtatgaaaatagttgggcatgcaaccccccagattgcccaggggttggtacaggttgtactgcttgtggattatatctagatcagttgaagccggtaggaacagccttcaaaattataagtgtacgatacagtagaaaagtgtgcgtgcagtttggtgaagaatacctttgcaaaacaattgatatgaacgattgctttgtgactaggcatgccaaaatatgtataattgggactgtatctaagttctctcaaggtgacactctactatttcttgggcccatggaaggaggtggtataatctttaaacactggtgtacatctacctgtcactttggagaccctggtgatgttatgggtccaaaagataaaccatttatttgccctgaattcccagggcaattcaggaagaaatgtaattttgccacaactccagtttgtgaatatgatgggaatattatttcaggctataagaaagttcttgcaacaattgattctttccaatcatttaacacaagcaatatacatttcactgatgagagaattgaatggagagaccctgatggtatgcttcgggatcatatcaatattgttatttctaaagatattgattttgaaaatttgggccagaatccttgtaaagtagggctccaggcagccaacatagaaggtgcttggggttcaggtgttgggtttacactcacatgccaggtgtctctcacagaatgcccaacatttctcacgtcaataaaggcttgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactgggcttcaagccagtgcaccacatctagataaggtaaatggtatctctgatttagaaaacgagaaagtttatgatgatggtgcacctgaatgtggtgttacttgctggtttaaaaaatcaggtgaatgggttatgggtataatcaatgggaactgggttgtcctaattgttttgtgtgtcctgctgctcttttctcttatcctgttgagcatcttgtgtcctgttagaaagcataaaaaatcataa

SEQ ID NO: 3455 - RNA, 3402 nt, synthetic construct
  misc_feature 1..3402: note = derived and/or modified CDS sequence (wt) from SEOV(HBQ17)__KM233655.1__GP
  source 1..3402: mol_type = other RNA
atgtggagtttgctattcgtggccgctttaattggtcagggctttgcattagaaaatgcgtttgacatgagaattcggtgtccccattcggtccactttggggaaacaagtgtgtcaggctatacagaattgcccccactctcattacaggaggcagaacagctagtgccagagagctcatgcaacatggataaccaccaatcactctcaacaataaataaattaactaaggtaatatggcggaaaaaagcaaatcaggaatcagcgaaccaaaattcatttgaagttgtggagagtgcactcaaaattaaagggttgtgtatgttaaagcatagaatggttgaagaatcatatagaaacaggagatcagtaatctgttatgatctagcctgtaatagtacattctgtaagccaactgtttacatgattgttcctatacatgcttgcaacatgatgaaaagctgtttgattggccttggtccctacagaatccaggttgtctacgaaaggacatactgcactacgggtatattgacagaaggaaagtgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcagggatattatatctgcattattggtggaaactctgcccctgtatatgcccctgctggtgaagactttagggcaatggaggttttttctgggattattacatcaccacatggggaagaccatgacctccctggtgaagaaattgcaacataccagatttcagggcagatagaggcaaaaattcctcatacagtgagctctaaaaacttaaaattgactgcttttgcaggtatcccatcatactcatcaactagtatattggctgcttcagaagatggtcgtttcatatttagtcctggtttatttcctaacctaaatcagtcagtctgtgacaacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttctccaatgtgtctggtgtccaagcaaaataggttcagagcagctgagcagcagatcagctttgtctgccaaagggtcgatatggatattatagtgtactgtaatggtcaaaaaaagacaatcctaacaaaaacattagttataggccaatgtatttataccattacaagtctcttttcactgttgccaggggttgcccattctattgctattgagttgtgtgtcccagggtttcatggctgggccacagctgcacttttgatcacattctgctttggctgggtattgatccctgcatgtacattagccattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatctatcatgtgtccaaggagagtgcccatactgctttacccactgtgaaccgacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttggcagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttgggcattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcgtgtggattatatctagatcaattgaagccagtaggaacagcctttaaaattataagtgtaagatacagtagaaaagtgtgcgtgcagtttggtgaagaatacctttgcaaaacaattgatatgaatgattgctttgtgactagacatgccaaaatatgtattattgggactgtatctaagttctctcaaggtgacactctactatttcttgggcccatggaaggaggtggtataatctttaagcactggtgtacgtctacctgtcacttcggagaccctggtgatgttatgggtccaaaagataaaccatttatttgccctgaattcccagggcaattcaggaagaaatgtaattttgccacaactccagtttgtgaatatgatgggaacattatttcaggctataagaaagttcttgcaacaattgattctttccaatcgtttaacacaagcaatatacacttcactgatgagagaattgaatggagagaccctgatggtatgcttcgggatcatatcaatattgttatttctaaagatattgattttgaaaatttggccgagaatccttgtaaagtagggctccaggcagcaaacatagaaggtgcttggggttcaggtgttgggtttacactcacatgccaggtgtctctcacagaatgcccaacattcctcacgtcaataaaggcctgtgacatggcaatttgttatggtgcagaaagtgtgacactctcacgaggacaaaatactgtcaaaattaccgggaaaggtggccatagtggttcttcatttaaatgctgtcatgggaaagaatgttcttcaactggccttcaagccagtgcaccacatctggataaggtaaatggtatctctgaattagaaaacgagaaagtttatgatgatggtgcacctgagtgtggcgttacttgttggtttaaaaaatcaggtgaatgggttatgggtataatcaatgggaactgggttgtcttaattgttttgtgtgtcctgctgctcttctctcttatcctgttgagcattttgtgtcctgttagaaagcataaaaaatcataa

SEQ ID NO: 3456 - RNA, 3402 nt, synthetic construct
  misc_feature 1..3402: note = derived and/or modified CDS sequence (wt) from SEOV(HBQ20)__KM233656.1__GP
  source 1..3402: mol_type = other RNA
atgtggagtttgctattcttggccgctttagttggtcagggctttgcattaaaaaatgtgtttgacatgagaattcagtgcccccattcagtcaactttggggaaacaagtgtgtcaggctatacagaattgcccccactctcattacaggaggcagaacagctagtgccagagagctcatgcaacatggataaccaccaatcactctcaacaataaataaattaactaaggtaatatggcgaaaaaaagcaaatcaggaatcagcaaaccaaaattcatttgaagttgtggagagtgaagtcagctttaaagggttgtgtatgttaaagcataggatggttgaagaatcatatagaaataggagatcagtaatctgttatgatctagcctgtaatagtacattctgtaagccaactgtttacatgattgttcctatacatgcttgcaacatgatgaaaagctgtttgattggccttggtccctacagaatccaggttgtctacgaaaggacatactgcactacgggtatattgacagaaggaaagtgctttgtccccgacaaggctgttgtcagtgcattgaagagaggcatgtatgccatagcaagcatagagacaatctgcttttttattcatcagaaagggaatacatataagatagtaactgtcattacatcagcaatgggctccaaatgtaataatacagatactaaagttcagggatattatatctgtattattggtggaaactctgcccctgtatatgcccctgctggtgaagactttagggcaatggaggttttttctgggattattacatcaccacatggggaagaccatgacctccctggcgaagaaattgcaacataccagatttcagggcagatagaggcaaaaatccctcatacagtgagctctaaaaacttaaaattgactgcttttgcaggtatcccatcttactcatcaactagtatattagctgcttcagaagatggtcgtttcatatttagtcctggtttatttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttctccgatgtgtctggtgtccaagcaaaataggttcagagcagctgagcagcagatcagctttgtctgccaaagggtcgatatggatattatagtgtactgtaatggtcaaaaaaagacaatcctaacaaaaacattagttataggccaatgtatttatactattacaagtctcttttcactgttgccaggggttgcccattctattgctattgagttgtgtgtcccagggtttcatggctgggccacagctgcacttttgatcacattctgctttggctgggtattgatccctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgcaagtacgagtgtgaaacattaaaggaattgaaggcacataatctatcatgtgttcaaggagagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcgtgtggattatatctagatcaattgaagccagtaggaacagcctttaaaattataagtgtaagatacagtagaaaagtgtgcgtgcagtttggtgaagaatacctttgtaaaacaattgatatgaatgattgctttgtgactagacatgccaaaatatgtattattgggactgtatctaagttctctcaaggtgacactctactatttcttgggcccatggaaggaggtggtataatctttaagcattggtgtacgtctacctgtcactttggagaccctggtgatgttatgggtccaaaagataaaccatttatttgccctgaattcccagggcaatttaggaagaaatgtaattttgccacaactccagtttgtgaatatgatgggaacattatttcaggctataagaaagttcttgcaacaattgattctttccaatcgtttaacacaagcaatatacacttcactgatgagagaattgaatggagagaccctgatggtatgcttcgggatcatatcaatattgttatttctaaagatactgattttgaaaatttggccgagaatccttgtaaagtagggctccaggcagcaaacatagaaggtgcttggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactggccttcaagccagtgcaccacatctggataaggtaaatggtatctctgaattagaaaacgagaaagtttatgatgatggtgcacctgaatgtggcgttacttgttggtttaaaaaatcaggtgaatgggttatgggtataatcaatgggaactgggttgtcttaattgttttgtgtgtcctgctgctcttctctcttatcctgttgagcattttgtgtcctgttagaaagcataaaaaatcataa

SEQ ID NO: 3457 - RNA, 3402 nt, synthetic construct
  misc_feature 1..3402: note = derived and/or modified CDS sequence (wt) from SEOV(HBQ43)__KM233657.1__GP
  source 1..3402: mol_type = other RNA
atgtggagtttgctattcttggccgctttagttggtcagggcgttgcattaaaaaatgtgtttgacatgagaattcagtgtccccattcagtcaactttggggaaacaagtgtgtcaggctatacagaattgcccccactctcattacaggaggcagaacagctagtgccagagagctcatgcaacatggataaccaccaatcactctcaacaataaacaaattaactaaggtaatatggcgaaaaaaagcaaatcaggaatcagcaaaccaaaattcatttgaagttgtggagagtgaagtcagctttaaagggttgtgtatgttaaagcataggatggttgaagaatcatatagaaacaggagatcagtaatctgttatgatctagcctgtaatagtacattctgtaagccaactgtttacatgattgttcctatacatgcttgcaacatgatgaaaagctgtttgattggccttggtccctacagaatccaggttgtctacgaaaggacatactgcactacgggtatattgacagaaggaaagtgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcagggatattatatctgtattattggtggaaactctgcccctgtatatgcccctgctggtgaagactttagggcaatggaggttttttctgggattattacatcaccacatggggaagaccatgacctccctggcgaagaaattgcaacataccagatttcagggcagatagaggcaaaaatccctcatacagtgagctctaaaaacttaaaattgactgcttttgcaggtatcccatcatactcatcaactagtatattagctgcttcagaagatggtcgtttcatatttagtcctggtttatttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttctccaatgtgtttggtgtccaagcaaaataggttcagagcagctgagcagcagatcagctttgtctgccaaagggtcgatatggatattatagtgtactgtaatggtcaaaaaaagacaatcctaacaaaaacattagttataggccaatgtatttatactattacaagtctcttttcactgttgccaggggttgcccattctattgctattgagttgtgtgtcccagggtttcatggctgggccacagctgcacttttgatcacattctgctttggctgggtattgatccctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatctatcatgtgttcaaggagagtgcccatattgctttacccactgtgaaccaacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattctaacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcgtgtggattatatctagatcaattgaagccagtaggaacagcctttaaaattataagtgtaagatacagtagaaaagtgtgcgtgcagtttggtgaagaatacctttgcaaaacaattgatatgaatgattgctttgtgactagacatgccaaaatatgtattattgggactgtatctaagttctctcaaggtgacactctactatttcttgggcccatggaaggaggtggtataatctttaagcactggtgtacgtctacctgtcacttcggagaccctggcgatgttatgggtccaaaagataaaccatttatttgccctgaattcccagggcaattcaggaagaaatgtaattttgccacaactccagtttgtgaatatgacgggaacattatttcaggctataagaaagttcttgcaacaattgattctttccaatcgtttaacacaagcaatatacacttcactgatgagagaattgaatggagagaccctgatggtatgcttcgggatcatatcaatattgttatttctaaagatattgattttgaaaatttggccgagaatccttgtaaagtagggctccaggcagcaaacatagaaggtgcttggggttcaggtgttgggtttacactcacatgccaggtgtctctcacagaatgcccaacatttctcacgtcaataaaggcctgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactggccttcaagccagtgcaccacatctggataaggtaaatggtttctctgaattagaaaacgagaaagtttatgatgatggtgcacctgaatgtggcgttacttgttggtttaaaaaatcaggtgaatgggttatgggtataatcaatgggaactgggttgtcttaattgttttgtgtatcctgctgctcttctctcttatcctgttgagcattttgtgtcctgttagaaagcataaaaaatcataa

SEQ ID NO: 3458 - RNA, 3402 nt, synthetic construct
  misc_feature 1..3402: note = derived and/or modified CDS sequence (wt) from SEOV(HBQ5)__KM233653.1__GP
  source 1..3402: mol_type = other RNA
atgtggagtttgctattcttggccgctttagttggtcagggctttgcattaaaaaatgtgtttgacatgagaattcagtgtccccattcagtcaactttggggaaacaagtgtgtcaggctatacagaattgcccccactctcattacaggaggcagaacagctagtgccagagagctcatgcaacatggataaccaccaatcactctcaacaataaataaattaactaaggtaatatggcgaaaaaaagcaaatcaggaatcagcaaaccaaaattcatttgaagttgtggagagtgaagttagctttaaagggttgtgtatgttaaagcatagaatggttgaagaatcatatagaaacaggagatcagtaatctgttatgatctagcctgtaatagtacattttgtaagccaactgtttacatgattgttcctatacatgcttgcaacatgatgaaaagctgtttgattggccttggtccctacagaatccaggttgtctatgaaaggacatactgcactacaggtatattgacagaaggaaagtgctttgtccccgacaaggctgttgtcagtgcattgaagagaggcatgtatgccatagcgagcatagagacaatctgcttttttattcatcagaaagggaatacatataagatagtgactgccattacatcagcaatgggctccaaatgtaataatacagatactaaagttcagggatattatatctgtattattggtggaaactctgcccctgtatatgcccctgctggtgaggactttagggcaatggaggttttttctgggattattacatcaccacatggggaagaccatgacctccctggcgaagaaattgcaacataccagatttcagggcagatagaggcaaaaatccctcatacagtgagctctaaaaacttaaaattgactgcttttgcaggtatcccatcatactcatcaactagtatattagcggcttcagaagatggtcgtttcatatttagtcctggtttattccctaacctaaatcagtcagtctgtgataacaatgcactccctttaatctggaggggcctaattgatttaacgggatactatgaggcagtccacccttgcaatgtattctgtgtcttatcaggaccgggtgcttcatgtgaagccttttcagaaggaggtattttcaatattacttctccaatgtgtctggtgtccaagcaaaataggttcagagcagctgagcagcagatcagctttgtctgccaaagggtcgatatggatattatagtatactgtaatggtcaaaaaaagacaatcctaacaaaaacattagttataggccaatgtatttatactattacaagtctcttttcactgttgccaggggttgcccattctattgctattgagttgtgtgtcccagggtttcatggctgggccacagctgcacttttgatcacattctgctttggctgggtattgatccctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatctatcatgtgttcaaggagagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattttgacaatgtggactcttcttctcattattgaatccatcctctgggcagcaagtgcagcagaaatcccccttgtacctctctggacagataatgctcatggcgttgggagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcgtgtggattatatctagatcaattgaagccagtaggaacagcctttaaaattataagtgtaagatacagtagaaaagtgtgcgtgcaatttggtgaagaatacctttgcaaaacaattgatatgaatgattgctttgtgactagacatgccaaaatatgtattattgggactgtatctaagttctctcaaggtgacactctactatttcttgggcccatggaaggaggtggtataatctttaagcactggtgtacgtctacctgtcactttggagaccctggtgatgttatgggtccaaaggataaaccatttatttgccctgaattcccagggcaattcaggaagaaatgtaattttgccacaactccagtttgtgaatatgatgggaacattatttcaggctacaagaaagttcttgcaacaattgattctttccaatcgtttaatacaagcaatatacacttcactgatgagagaattgaatggagagaccctgatggtatgctccgggatcatatcaatattgttatttctaaagatattgattttgaaaatttggccgagaatccttgtaaagtagggctccaggcagcaaacatagaaggtgcttggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactggccttcaagccagtgcaccacatctggataaggtaaatggtatctctgaattagaaaacgagaaagtttatgatgatggtgcacctgaatgtggcgttacttgttggtttaaaaaatcaggtgaatgggttatgggtataatcaatgggaactgggttgtcttaattgttttgtgtgtcctgctgctcttctctcttatcctgttgagcattttgtgtcctgttagaaagcataaaaaatcataa

SEQ ID NO: 3459 - RNA, 3402 nt, synthetic construct
  misc_feature 1..3402: note = derived and/or modified CDS sequence (wt) from SEOV(HBT14)__KM233658.1__GP
  source 1..3402: mol_type = other RNA
atgtggagtttgctattcttggccgctttagttggtcagggctttgcattaaaaaatgtgtttgacatgagaattcagtgtccccattcagtcaactttggggaaacaagtgtgtcaggctatacaggattgcccccactctcattacaggaggcagaacagctagtgccagagagctcatgcaacatggataaccaccaatcactctcaataataaataaattaactaaggtaatatggcgaaaaaaagcaaatcaggaatcagcaaaccaaaattcatttgaagttgtggagagtgaagtcagctttaaagggttgtgtatgttaaagcatagaatggttgaagaatcatatagaaataggagatcagtaatctgttatgatctagcctgtaatagtacattctgtaagccaactgtttacatgattgttcctatacatgcttgcaatatgatgaaaagctgtttgattggccttggtccctacagaatccaggttgtctacgaaaggacatactgcactacgggtatattgacagaaggaaagtgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcagggatattatatctgtattattggtggaaactctgcccctgtatatgcccctgctggtgaagactttagggcaatggaggttttttctgggattattacatcaccacatggggaagaccatgacctccctggcgaagaaattgcaacataccagatttcagggcagatagaggcaaaaatccctcatacagtgagctctaaaaacttaaaattgactgcttttgcaggtatcccatcatactcatcaactagtatattagctgcttcagaagatggtcgtttcatatttagtcctggtttatttcctaacctaaatcagtcagtctgtgataacaatgcacttcctttaatctggaggggcctaattgatttaacgggatactatgaggcagtccacccttgcaatgtattctgtgtcttatcaggaccaggtgcttcatgtgaagccttttcagaaggaggcattttcaatattacttctccaatgtgtctggtgtccaagcaaaataggttcagagcagctgagcagcagatcagctttgtctgccaaagggtcgatatggatattatagtgtactgtaatggtcaaaaaaagacaatcctaacaaaaacattagttataggccaatgtatttatactattacaagtctcttttcactgttgccaggggttgcccattctattgctattgagttgtgtgtcccagggtttcatggctgggccacagctgcacttttgatcacattctgctttggctgggtattgatccctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatctatcatgtgttcaaggagagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattctgacaatgtggactcttcttctcattattgaatccatcctctgggcagcaagtgcagcagaaattccacttgtccctctctggacagataatgctcatggcgttgggagtgttcctatgcatacagatcttgaattagacttttctttgccatctagttctaagtatacatataaacgacatcttacaaacccagttaatgaccaacagagtgtctcattgcatatagaaattgaaagtcaaggcattggtgctgatgttcatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcgtgtggattatatctagatcaattgaagccagtaggaacagcctttaaaattataagtgtaagatacagtagaaaagtgtgcgtgcagtttggtgaagagtacctttgcaaaacaattgatatgaatgattgctttgtgactagacatgccaaaatatgtattattgggactgtatctaagttctctcaaggtgacactctactatttcttgggcccatggaaggaggtggtataatctttaagcactggtgtacgtctacctgtcactttggagaccctggtgatgttatgggtccaaaagataaaccatttatttgccctgaattcccagggcaattcaggaagaaatgtaattttgccacaactccagtttgtgaatatgatgggaacattatttcaggctataagaaagttcttgcaacaattgattctttccaatcgtttaacacaagcaatatacacttcactgatgagagaattgaatggagagaccctgatggtatgcttagggatcatatcaatattgttatttctaaagatattgattttgaaaatttggccgagaatccttgtaaagtagggctccaggcagcaaacatagagggtgcttggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactggccttcaagccagtgcaccacatctggataaggtaaatggtatctctgaattagaaaacgagaaagtttatgatgatggtgcacctgaatgtggcgttacttgttggtttaaaaaatcaggtgaatgggttatgggtataatcaatgggaactgggttgtcttaattgttttgtgtgtcctgctgctcttctctcttatcctgttgagcattttgtgtcctgttagaaagcataaaaaatcataa

SEQ ID NO: 3460 - RNA, 3402 nt, synthetic construct
  misc_feature 1..3402: note = derived and/or modified CDS sequence (wt) from SEOV(HBT-3)__KM233661.1__GP
  source 1..3402: mol_type = other RNA
atgtggagtttgctattcttggccgctttagttggtcagggctttgcattaaaaaatgtgtttgacatgagaattcagtgtccccattcagtcaactttggggaaacaagtgtgtcaggctatacagaattgcccccactctcattacaggaggcagaacagctagtgccagagagctcatgcaacatggataaccaccaatcactctcaacaataaataaattaactaaggtaatatggcgaaaaaaagcaaatcaggaatcagcaaaccaaaattcatttgaagttgtggagagtgaagtcagctttaaagggttgtgtatgttaaagcatagaatggttgaagaatcatatagaaataggagatcagtaatctgttatgatctaccctgtaatagtacattctgtaagccaactgtttacatgattgttcctatacatgcttgcaacatgatgaaaagctgtttgattggccttggtccctacagaatccaggttgtctacgaaaggacatactgcactacaggtatattgacagaaggaaagtgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcagggatattatatctgtattattggtggaaactctgcccctgtatatgcccctgctggtgaagactttagggcaatggaggttttttctgggattattacatcaccacatggggaagaccatgacctccctggcgaagaaattgcaacataccagatttcagggcagatagaggcaaaaatccctcatacagtgagctctaaaaacttaaaattgactgcttttgcaggtatcccatcatactcatcaactagtatattagctgcttcagaagatggtcgtttcatatttagtcctggtttatttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaagggggtattttcaatattacttctccaatgtgtctggtgtccaagcaaaataggttcagagcagctgagcagcagatcagctttgtctgccaaagggtcgatatggatattatagtgtactgtaatggtcaaaaaaagacaatcctaacaaaaacattagttataggccaatgtatttatactattacaagtctcttttcactgttgccaggggttgcccattctattgctattgagttgtgtgtcccagggtttcatggctgggccacagctgcacttttgatcacattctgctttggctgggtattgatccctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattcaaggaattgaaggcacataatctatcatgtgttcaaggagagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggtgttggcagtgttcctatgcatacagatcttgaattagacttttctttaccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcgtgtggattatatctagatcaattgaagccagtaggaacagcctttaaaattataagtgtaagatacagtagaaaagtgtgcgtgcagtttggtgaagaatacctttgcaaaacaattgatatgaatgattgctttgtgactagacatgccaaaatatgtattattgggactgtatctaagttctctcaaggtgacactctactatttcttgggcccatggaaggaggtggtataatctttaagcactggtgtacgtctacctgtcactttggagaccctggtgatgttatgggtccaaaagataaaccatttatttgccctgaattcccagggcaattcaggaagaaatgtaattttgccacaactccagtttgtgaatatgatgggaacattatttcaggctataagaaagttcttgcaacaattgattctttccaatcgtttaacacaagcaatatacacttcactgatgagagaattgaatggagagaccctgatggtatgcttcgggatcatatcaatattgttatttctaaagatattgattttgaaaatttggccgagaatccttgtaaagtagggctccaggcagcaaacatagaaggtgcttggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactggccttcaagccagtgcaccacatctggataaggtaaatggtatctctgaattagaaaacgaaaaagtttatgatgatggtgcacctgaatgtggcgttacttgttggtttaaaaaatcaggtgaatgggttatgggtataatcaatgggaactgggttgtcttaattgttttgtgtgtcctgctgctcttctctcttatcctgttgagcattttgtgtcctgttagaaagcataaaaaatcataa

SEQ ID NO: 3461 - RNA, 3402 nt, synthetic construct
  misc_feature 1..3402: note = derived and/or modified CDS sequence (wt) from SEOV(HBT49)__KM233659.1__GP
  source 1..3402: mol_type = other RNA
atgtggagtttgctattcttggccgctttagttggtcagggctttgcattaaaaaatgtgtttgacatgagaattcagtgtccccattcagtcaactttggggaaacaagtgtgtcaggctatacagaattgcccccactctcattacaggaggcagaacagctagtgccagagagctcatgcaacatggataaccaccaatcactctcaacaataaataaattaactaaggtaatatggcgaaaaaaagcaaatcaggaatcagcaaaccaaaattcatttgaagttgtggagagtgaagtcagctttaaagggttgtgtatgttaaagcatagaatggttgaagaatcatatagaaacaggagatcagtaatctgttatgatctagcctgtaatagtacattctgtaagccaactgtttacatgattgttcctatacatgcttgcaacatgatgaaaagctgtttgattggccttggtccctacagaatccaggttgtctacgaaaggacatactgcactacgggtatattgacagaaggaaagtgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcagggatattatatctgtattattggtggaaactctgcccctgtatatgcccctgctggtgaagactttagggcaatggaggttttttctgggattattacatcaccacatggggaagaccatgacctccctggcgaagaaattgcaacataccagatttcagggcagatagaggcaaaaatccctcatacagtgagctctaaaaacttaaaattgactgcttttgcaggtatcccatcatactcatcaactagtatattagctgcttcagaagatggtcgtttcatatttagtcctggtttatttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttctccaatgtgtctggtgtccaagcaaaacaggttcagagcagctgagcagcagatcagctttgtctgccaaagggtcgatatggatattatagtgtactgtaatggtcaaaaaaagacaatcctaacaaaaacattagttataggccaatgtatttatactattacaagtctcttttcactgttgccaggggttgcccattctattgctattgagttgtgtgtcccagggtttcatggctgggccacagccgcacttttgatcacattctgctttggctgggtattgatccctgcatgtacattagctattcttctagttctcaagttttttgcaaatatccttcatacaagcaaccaagagaatcgattcaaagccattctacggaaaataaaggaagagtttgaaaaaacaaagggttccatggtttgtgagatctgtaagtacgagtgtgaaacattaaaggaattaaaggcacataatctatcatgtgttcaaggagagtgcccatattgctttacccactgtgaaccgacagaaactgcaattcaggcacattacaaagtttgccaagccacccatcgattcagagaagatttaaaaaagactgtaactcctcaaaatattgggccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgagttagacttttctttgccatctagttctaagtatacatataaaagacatcttacaaacccagttaatgaccaacagagtgtctcattgcatatagaaattgaaagtcaaggcattggtgctgatgtttatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcatgtggattatatctagatcaattgaagccagtaggaacagcctttaaaattataagtgtaagatacagtagaaaagtgtgcgtgcagtttggtgaagaatacctttgcaaaacaattgatatgaatgattgctttgtgactagacatgccaaaatatgtattattgggactgtatctaagttctctcaaggtgacactctactatttcttgggcccatggaaggaggtggtataatctttaagcactggtgtacgtctacctgtcactttggagaccctggtgatgttatgggtccaaaagataaaccatttatttgccctgaattcccagggcaattcaggaagaaatgtaattttgccacaactccagtttgtgaatatgatgggaacattatttcaggttataagaaagttcttgcaacaattgattctttccaatcgtttaacacaagcaatatacacttcacagatgagagaattgaatggagagaccctgatggtatgcttcgggatcatatcaatattgttatttctaaagatattgattttgaaaacttggccgaaaatccttgtaaagtagggctccaggcagcaaacatagaaggtgcttggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaaaattaccgggaaaggtggtcatagtggttcttcatttaaatgctgtcatgggaaagaatgttcatcaactggccttcaagccagtgcaccacatctggataaggtaaatggtatctctgaattagaaaacgagaaagtttatgatgatggtgcacctgaatgtggcgttacttgttggtttaaaaaatcaggtgaatgggttatgggtataatcaatgggaactgggttgtcttaattgttttgtgtgtcctgctgctcttttctcttatcctgttgagcattttgtgtcctgttagaaagcataaaaaatcataa

SEQ ID NO: 3462 - RNA, 3402 nt, synthetic construct
  misc_feature 1..3402: note = derived and/or modified CDS sequence (wt) from SEOV(HBT50)__KM233660.1__GP
  source 1..3402: mol_type = other RNA
atgtggagtttgctattcttggccgctttagttggtcagggctttgcattaaaaaatgtgtttgacatgagaattcagtgtccccattcagtcaactttggggaaacaagtgtgtcaggctatacagaattgcccccgctctcattacaggaggcagaacagctagtgccagagagctcatgcaacatggataaccaccaatcactctcaacaataaataaattaactaaggtaatatggcgaaaaaaagcaaatcaggaatcagcaaaccaaaattcatttgaagttgtggagagtgaagtcagctttaaagggttgtgtatgttaaagcatagaatggttgaagaatcatatagaaacaggagatcagtaatctgttatgatctagcctgtaatagtacattctgtaagccaactgtttacatgattgttcctatacatgcttgcaacatgatgaaaagctgtttgattggccttggtccctacagaatccaggttgtctacgaaaggacatactgcactacgggtatattgacagaaggaaagtgctttgtccccgacaaggctgttgtcagtgcattgaagagaggcatgtatgccatagcaagcatagagacaatctgcttttttattcatcagaaagggaatacatataagatagtgactgccattacatcagcaatgggctccaaatgtaataatacagatactaaagttcagggatattatatctgtattattggtggaaactctgcccctgtatatgcccctgctggtgaagactttagggcaatggaggttttttctgggattattacatcaccacatggggaagaccatgacctccctggcgaagaaattgcaacataccagatttcagggcagatagaggcaaaaatccctcatacagtgagctctaaaaacttaaaattgactgcttttgcaggtatcccatcatactcatcaactagtatattagctgcttcagaagatggtcgtttcatatttagtcctggtttatttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttctccaatgtgtctggtgtccaagcaaaataggttcagagcagctgagcagcagatcagctttgtctgccaaagggtcgatatggatattatagtgtactgtaatggtcaaaaaaagacaatcctaacaaaaacattagttataggccaatgtatttatactattacaagtctcttttcactgttgccaggggttgcccattctattgctattgagttgtgtgtcccagggtttcatggctgggccacagccgcacttttgatcacattctgctttggctgggtattgatccctgcatgtacattagctattcttctagttctcaagttttttgcaaatatccttcatacaagcaaccaagagaatcgattcaaagccattctacggaaaataaaggaagagtttgaaaaaacaaagggttccatggtttgtgagatctgtaagtacgagtgtgaaacattaaaggaattaaaggcacataatctatcatgtgttcaaggagagtgcccatattgctttacccactgtgaaccgacagaaactgcaattcaggcacattacaaagtttgccaagccacccatcgattcagagaagatttaaaaaagactgtaactcctcaaaatattgggccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgagttagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaacctaaaaacctcatttcattgctatggtgcctgcacaaaataccaatacccatggcacactgcaaaatgccattttgagaaagattatgagtatgaaaatagttgggcatgcaaccccccggattgcccaggggttggtacaggttgtactgcatgtggattatatctagatcaattgaagccagtaggaacagcctttaaaattataagtgtaagatacagtagaaaagtgtgcgtgcagtttggtgaagaatacctttgcaaaacaattgatatgaatgattgctttgtgactagacatgccaaaatatgtattattgggactgtatctaagttctctcaaggtgacactctactatttcttgggcccatggaaggaggtggtataatctttaggcactggtgtacgtctacctgtcactttggagaccctggtgatgttatgggtccaaaagataaaccatttatttgccctgaattcccagggcaattcaggaagaaatgtaattttgccacaactccagtttgtgaatatgatgggaacattatttcaggttataagaaagttcttgcaacaattgattctttccaatcgtttaacacaagcaatatacacttcactgatgagagaattgaatggagagaccctgatggtatgcttcgggatcatatcaatattgttatttctaaagatattgattttgaaaacttggccgaaaatccttgtaaagtagggctccaggcagcaaacatagaaggtgcttggggttcaggtgtcgggtttacactcacatgccaggtgtctctcacagaatgcccaacatttctcacgtcaataaaggcctgtgacatggcaatttgttatggtgcagaaagtgtgacactctcacgaggacaaaatactgtcaaaattaccgggaaaggtggtcatagtggttcttcatttaaatgctgtcatgggaaagaatgttcatcaactggccttcaagccagtgcaccacatctggataaggtaaatggtatctctgaattagaaaacgagaaagtttatgatgatggtgcgcctgaatgtggcgttacttgttggtttaaaaaatcaggtgaatgggttatgggtataatcaatgggaactgggttgtcttaattgttttgtgtgtcctgctgctcttttctcttatcctgttgagcattttgtgtcctgttagaaagcataaaaaatcataa

SEQ ID NO: 3463 - RNA, 3402 nt, synthetic construct
  misc_feature 1..3402: note = derived and/or modified CDS sequence (wt) from SEOV(HuludaoRn101)__GU592923.1__GP
  source 1..3402: mol_type = other RNA
atgtggagtttgctattactggccgctttagttggccaaggctttgcattaaaaaatgtttttgacatgagaattcagtgtccccactcagtcaactttggggaaacaagtgtgtcaggctatacagaattgcccccactctcattacaagaggcagaacagctagtaccagagagctcatgcaacatggacaaccaccaatcactctcaacaataaataaattaaccaaggtcgtatggcgaaaaaaagcaaatcaggaatcagcaaaccagaattcatttgaagttgtggagagtgaagtcagctttaaagggttgtgtatgttaaagcacagaatggttgaagaatcatatagaaacagaagatctgtaatctgttatgatctagcctgtaatagtacattctgtaagccaactgtttacatgattgttcctatacatgcttgcaacatgatgaaaagttgtttgattggccttggtccctacagaattcaggttgtctatgaaaggacatactgcactacgggtatattgacagaaggaaaatgttttgtccctgacaaggctgttgtcagtgcattgaagagaggcatgtatgccatagcaagcatagagacaatctgcttttttattcatcagaaagggaatacatataaaatagtgactgccatcacatcagcaatgggctccaagtgcaataatacagatactaaggtccaaggatattatatctgtattattggtggaaactctgctcctgtatatgcccccgctggtgaagactttagggcaatggaggttttttctgggattattacgtcaccgcatggagaagaccatgacctccctggcgaagaaatcgcaacataccagatttcagggcagatagaggcaaaaatccctcatacagtgagctctaaaaacttgaaattgattgcctttgcaggtattccatcatactcatcaactagtatattggctgcttcagaagacagtcgtttcatatttagtcctggtttatttcctaatttaaatcagtcagtctgtgacaacaatgcactccctttaatctggaggggcctaattgacttaacaggatactatgagacagtccacccttgcaatgtattctgtgtcttatcaggaccaggtgcttcatgtgaagccttttcagagggaggtattttcaacattacttctccaatgtgtctggtgtccaagcaaaataggtttagagcagctgagcagcaaatcagctttatttgccaaagggttgatatggatattatagtgtactgtaatggtcaaaaaaagacaatattaacaaaaacattagttataggccagtgcatttatactattacaagtctcttttcactgttaccaggggttgcccattctattgctattgagttgtgtgttccaggttttcatggctgggccacagctgcacttttgatcacattttgctttggctgggtactgattcctgcatgcacattagctattcttttagtcctaaagttttttgcaaatatccttcatacaagcaatcaagagaaccgattcaaagccattctacggaaaatcaaggaggagtttgaaaaaacaaagggttccatggtttgtgagatctgtaagtacgagtgtgagacattaaaggaattaaaggcacataatttatcatgtgtgcaaggggagtgcccatattgctttacgcactgtgaaccgacagaaactgcaattcaggcacattacaaagtttgtcaagccacccaccgattcagagaagatttaaaaaagactgtaactcctcaaaatattgggccaggctgttaccgaacattgaatctttttaggtataaaagtaggtgttatattctaacaatgtggactcttcttctcattattgaatccatcctctgggcggcaagtgcagcagaaatcccccttgtccctctctggacagataatgctcatggcgttgggagcattcctatgcatacggatcttgaattagacttttctttgccatctagctctaagtacacatataaaaggcatctcacaaacccagttaatgaccaacagagtgtctcattgcatatagaaattgaaagtcaaggtattggtgctgatgtccaccatcttggacattggtatgatgcaaggttaaatctgaaaacctcattccattgttatggtgcctgcacaaaataccaatatccatggcacactgcaaaatgccattttgagaaagattatgagtatgaaaatagctgggcatgcaaccccccagattgtccaggggttggtacaggttgtactgcctgtggattatatctagatcaattgaagccggtaggaacagcctttaaaattataagtgtaagatatagtagaaaagtgtgcgtgcagtttggtgaagaatacctttgcaaaacaattgatatgaatgactgctttgtgactaggcatgccaaaatatgtataattgggactgtatctaagttttctcaaggtgacactctactatttcttggacccatggaaggaggtggtataatctttaaacactggtgtacatctacctgtcactttggagaccctggtgatgtcatgggtccaaaagataaaccatttatttgccctgaattcccagggcaattcaggaaaaaatgtaactttgccacaactccaatttgtgaatatgatgggaacattatctcaggttataagaaagtccttgcaacaattgattcttttcaatcatttaacacaagcaatatacacttcactgatgagagaattgaatggagagaccctgatggtatgcttcgggatcatattaatgtcgttatttctaaagatattgattttgaaaatttggctgagaatccttgtaaagtagggctccaggcagcaaacatagaaggtgcttggggctcaggtgtcgggtttacactcacatgccaggtgtctctcacagaatgcccaacatttcttacgtcaataaaggcctgtgacatggcaatttgttatggtgcagaaagtgtgacactttcacgaggacaaaatactgtcaggattactggaaaaggtggccatagtggttcttcatttaaatgctgtcatgggaaagaatgttcatcaactggcctccaagccagtgcaccacatttggataaagtaaatggtatctctgagttagaaaacgagaaagtttatgatgatggtgcacctgaatgtggcgttacttgttggtttaaaaaatcaggtgaatgggttatgggtataatcaacgggaactgggttgtcctaattgttctgtgtgtcctgttactcttttctcttatcctgttaagcattttgtgtcctgttagaaagcataaaaaatcataa

SEQ ID NO: 3464 - RNA, 3402 nt, synthetic construct
  misc_feature 1..3402: note = derived and/or modified CDS sequence (wt) from SEOV(Humber)__JX879768.1__GP
  source 1..3402: mol_type = other RNA
atgtggagtttgctattactggccgctttagttggccaaggctttgcattaaaaaatgtttttgacatgagaatccagtgtcctcactcagtcaactttggggaaacaagtgtgtcaggctatacggaactgcccccactatcattacaggaggcagaacagctagtgccagagagctcatgcaacatggacaaccaccaatcactctcaacaataaataaattgacaaaggtcatatggcgaaagaaagcaaatcaggaatcagcaaaccagaattcatttgaagttgtggagagtgaagtcagctttaaagggttgtgtatgttaaagcatagaatggttgaagaatcatatagaaacaggagatcagtaatctgttatgatctagcctgtaatagtacattctgtaaaccaactgtttacatgattgttcctatacatgcttgcaacatgatgaaaagctgtttaattggccttggtccctatagaatccaggttgtctatgaaaggacatactgcactacaggtatattgacagaaggaaaatgctttgtccctgacaaggctgttgttagtgcattgaagaggggtatgtatgccatagcaagcatagagacaatctgcttttttgttcatcagaaagggaatacatataagatagtaactgccattacatcagcaatgggctctaaatgtaataatacagatactaaagttcaaggatattatatctgtattattggtggaaactccgcccctgtatattcccctgctggtgaagactttagggcaatggaagttttttctgggattattacatcaccacatggagaagaccatgatctccctggtgaagaaattgcaacataccagatttcagggcaaatagaggcaaaaatccctcatacagtgagctctaaaaacttaaagttaactgcttttgcaggtattccatcatactcatcaaccagtatactggctgcttcagaagatggtcgtttcatatttagtcctggtctatttcctaacctaaatcagtcagtctgtgacaacaatgcactccctttaatctggaggggcctaattgatttaacaggatactatgaggcagtccacccttgtaatgtattctgtgtcttatcaggaccaggtgcttcatgtgaagccttttcagaaggaggtatttttaatattacttctccaatgtgtctggtgtcaaaacaaaataggtttagagcagccgagcagcagatcagctttatttgccaaagggttgatatggatattatagtgtactgtaatggtcaaaaaaagacaatcctaacaaaaacattagttataggccaatgtatctatactattacaagtctcttttcactgttaccaggggttgcacattctattgctattgagctgtgtgttccagggtttcatggctgggccacagctgcactcttgatcacattctgctttggctgggtattaattcctgcatgtacattagctgttcttttagtcctcaagttttttgcaaatatccttcatacaagcaatcaagaaaaccgattcaaagccattctacggaaaataaaggaggagtttgaaaaaacaaagggttccatggtctgtgagatctgtaagtacgagtgtgaaacattaaaagaattgaaggcacataacctatcatgcattcaaggggaatgcccatattgcttcacccactgtgaaccaacagaaactgcaattcaggcacattataaagtttgtcaagccacccaccgattcagagaagatttaaaaaagactgtaactcctccaaatattgggccaggctgttaccgaacactaaatctcttcaggtataaaagtagatgttatattctgacaatgtggactcttcttctcattattgagtccatcctctgggcagcaagtgcagcagaaatcccccttgtccctctctggacagataatgcacacggcgttggtagtgttcctatgcatacagatcttgaattagacttttccttgccatctagctctaagtatacatataaaagacatctcacaaacccagttaatgaccaacagagtgtttcattgcatatagaaattgaaagccaaggcattggtgctgatgttcatcatcttggacattggtatgatgcaagattaaatctaaaaacctcatttcattgttatggtgcctgcacaaaatatcaatatccatggcacactgcaaaatgtcattttgagaaagattatgagtatgaaaacagctgggcttgcaaccccccagattgcccaggggttggtacaggttgtactgcttgtggattatatttagatcaactgaagccggtaggaacagccttcaaaattataagtgtaagatacagcagaaaagtgtgcgtgcagtttggtgaagaatacctttgtaaaacgattgatatgaatgattgctttgtgactaggcatgccaaaatatgtataattgggactgtatctaagttctctcaaggtgacactctactatttcttgggcctatggaaggaggtggtataatctttaaacactggtgtacatctacctgtcactttggagaccctggtgatgtcatgggtccaaaagataaaccctttatttgccctgaattcccaggacaattcaggaaaaaatgtaactttgccacaactccggtttgcgaatatgatggaaacattatttcaggatataaaaaagttcttgcaacaattgattctttccaatcatttaacacaagcaatatacatttcactgatgagagaattgaatggagagaccctgatggtatgcttcgggatcatatcaatatcattatttccaaagatattgattttgaaaatttggctgagaatccttgtaaagtagggctccaggcagcaaacatagaaggtgcttggggttcaggtgttgggtttacactcacatgccaggtatctcttacagaatgcccaacatttctcacgtcaataaaggcttgtgacatggcaatttgttatggtgcagaaagcgtgacactctcacgaggacaaaatactgtcaagattactgggaaaggtggccatagtggttcttcatttaaatgctgtcacgggaaagaatgttcatcaaatggtctccaagccagtgcaccgcatctggataaggtaaatggtatctctgagttagaaaatgagaaagtttatgatgatggtgcacctgaatgtggcgttacttgttggtttaaaaagtcaggtgaatgggttatgggtataatcaatgggaactgggttgtcctaattgttctgtgtgtcctgttactcttttctcttatcctgttgagcattttgtgtcctgttaggaagcataaaaaatcataa

SEQ ID NO: 3465 - RNA, 3402 nt, synthetic construct
  misc_feature 1..3402: note = derived and/or modified CDS sequence (wt) from SEOV(Humber)__KM948597.1__GP
  source 1..3402: mol_type = other RNA
atgtggagtttgctattactggccgctttagttggccaaggctttgcattaaaaaatgtttttgacatgagaatccagtgtcctcactcagtcaactttggggaaacaagtgtgtcaggctatacggaactgcccccactatcattacaggaggcagaacagctagtgccagagagctcatgcaacatggacaaccaccaatcactctcaacaataaataaattgacaaaggtcatatggcgaaagaaagcaaatcaggaatcagcaaaccagaattcatttgaagttgtggagagtgaagtcagctttaaagggttgtgtatgttaaagcatagaatggttgaagaatcatatagaaacaggagatcagtaatctgttatgatctagcctgtaatagtacattctgtaaaccaactgtttacatgattgttcctatacatgcttgcaacatgatgaaaagctgtttaattggccttggtccctatagaatccaggttgtctatgaaaggacatactgcactacaggtatattgacagaaggaaaatgctttgtccctgacaaggctgttgttagtgcattgaagaggggtatgtatgccatagcaagcatagagacaatctgcttttttgttcatcagaaagggaatacatataagatagtaactgccattacatcagcaatgggctctaaatgtaataatacagatactaaagttcaaggatattatatctgtattattggtggaaactccgcccctgtatattcccctgctggtgaagactttagggcaatggaagttttttctgggattattacatcaccacatggagaagaccatgatctccctggtgaagaaattgcaacataccagatttcagggcaaatagaggcaaaaatccctcatacagtgagctctaaaaacttaaagttaactgcttttgcaggtattccatcatactcatcaaccagtatactggctgcttcagaagatggtcgtttcatatttagtcctggtctatttcctaacctaaatcagtcagtctgtgacaacaatgcactccctttaatctggaggggcctaattgatttaacaggatactatgaggcagtccacccttgtaatgtattctgtgtcttatcaggaccaggtgcttcatgtgaagccttttcagaaggaggtatttttaatattacttctccaatgtgtctggtgtcaaaacaaaataggtttagagcagccgagcagcagatcagctttatttgccaaagggttgatatggatattatagtgtactgtaatggtcaaaaaaagacaatcctaacaaaaacattagttataggccaatgtatctatactattacaagtctcttttcactgttaccaggggttgcacattctattgctattgagctgtgtgttccagggtttcatggctgggccacagctgcactcttgatcacattctgctttggctgggtattaattcctgcatgtacattagctgttcttttagtcctcaagttttttgcaaatatccttcatacaagcaatcaagaaaaccgattcaaagccattctacggaaaataaaggaggagtttgaaaaaacaaagggttccatggtctgtgagatctgtaagtacgagtgtgaaacattaaaagaattgaaggcacataacctatcatgcattcaaggggaatgcccatattgcttcacccactgtgaaccaacagaaactgcaattcaggcacattataaagtttgtcaagccacccaccgattcagagaagatttaaaaaagactgtaactcctccaaatattgggccaggctgttaccgaacactaaatctcttcaggtataaaagtagatgttatattctgacaatgtggactcttcttctcattattgagtccatcctctgggcagcaagtgcagcagaaatcccccttgtccctctctggacagataatgcacacggcgttggtagtgttcctatgcatacagatcttgaattagacttttccttgccatctagctctaagtatacatataaaagacatctcacaaacccagttaatgaccaacagagtgtttcattgcatatagaaattgaaagccaaggcattggtgctgatgttcatcatcttggacattggtatgatgcaagattaaatctaaaaacctcatttcattgttatggtgcctgcacaaaatatcaatatccatggcacactgcaaaatgtcattttgagaaagattatgagtatgaaaacagctgggcttgcaaccccccagattgcccaggggttggtacaggttgtactgcttgtggattatatttagatcaactgaagccggtaggaacagccttcaaaattataagtgtaagatacagcagaaaagtgtgtgtgcagtttggtgaagaatacctttgtaaaacgattgatatgaatgattgctttgtgactaggcatgccaaaatatgtataattgggactgtatctaagttctctcaaggtgacactctactatttcttgggcctatggaaggaggtggtataatctttaaacactggtgtacatctacctgtcactttggagaccctggtgatgtcatgggtccaaaagataaaccctttatttgccctgaattcccaggacaattcaggaaaaaatgtaactttgccacaactccggtttgcgaatatgatggaaacattatttcaggatataaaaaagttcttgcaacaattgattctttccaatcatttaacacaagcaatatacatttcactgatgagagaattgaatggagagaccctgatggtatgcttcgggatcatatcaatatcattatttccaaagatattgattttgaaaatttggctgagaatccttgtaaagtagggctccaggcagcaaacatagaaggtgcttggggttcaggtgttgggtttacactcacatgccaggtatctcttacagaatgcccaacatttctcacgtcaataaaggcttgtgacatggcaatttgttatggtgcagaaagcgtgacactcttacgaggacaaaatactgtcaagattactgggaaaggtggccatagtggttcttcatttaaatgctgtcacgggaaagaatgttcatcaaatggtctccaagccagtgcaccgcatctggataaggtaaatggtatctctgagttagaaaatgagaaagtttatgatgatggtgcacctgaatgtggcgttacttgttggtttaaaaagtcaggtgaatgggttatgggtataatcaatgggaactgggttgtcctaattgttctgtgtgtcctgttactcttttctcttatcctgttgagcattttgtgtcctgttaggaagcataaaaaatcataa

SEQ ID NO: 3466 - RNA, 3402 nt, synthetic construct
  misc_feature 1..3402: note = derived and/or modified CDS sequence (wt) from SEOV(K24-e7)__AF288652.1__GP
  source 1..3402: mol_type = other RNA
atgtggagtttgctattactggccgctttagttggccaaggctttgcattaaaaaatgtttttgacatgagaattcagtgtccccactcagtcaactttggggaaacaagtgtgtcaggctatacagaattgcccccactctcattacaagaggcagaacagctagtgccagagagctcatgcaacatggacaaccaccaatcactctcaacaataaataaattaaccaaggtcgtatggcgaaaaaaagcaaatcaggaatcagcaaaccagaattcatttgaagttgtggagagtgaagtcagctttaaagggttatgtatgttaaagcatagaatggttgaagaatcatatagaaacagaagatctgtaatctgttatgatctagcctgtaatagtacattctgtaagccaactgtttacatgattgttcctatacatgcttgcaacatgatgaaaagttgtttgattggccttggtccctacagaattcaggttgtctatgaaaggacatactgcactacgggtatattgacagaaggaaaatgttttgtccccggcaaggctgttgtcagtgcattgaagagaggcatgtatgccatagcaagcatagagacaatctgcttctttattcatcagaaagggaatacatataaaatagtgactgccatcacatcagcaatgggctccaagtgcaataatacagatactaaggtccaaggatattatatctgtattattggtggaaactctgctcctgtgtatgcccccgctggtgaagactttagggcaatggaggttttttctgggattattacgtcaccgcatggagaagaccatgacctccctggcgaagaaatcgcaacataccagatttcagggcagatagaggcaaaaatccctcatacagtgagctctaaaaacttgaaattgattgcctttgcaggtattccatcatactcatcaactagtatattggctgcttcagaagacggtcgtttcatatttagtcctggtttatttcctaatttaaatcagtcagtctgtgacaacaatgcacttcctttgatctggaggggcctaattgacttaacgggatactatgaggcagtccacccttgcaatgtattccgtgtcttatcaggaccaggtgcttcatgtgaagccttttcagagggaggtattttcaacattacttctccaatgtgtctggtgtccaagcaaaataggtttagagcagctgagcagcaaatcagctttatttgccaaagggttgatatggatattatagtgtactgtaatggtcaaaaaaagacaatattaacaaaaacattagttataggccagtgcatttatactattacaagtctcttttcactgttaccaggggtcgcccattctattgctattgagttgtgtgttccaggttttcatggctgggccacagctgcacttttgatcacattttgctttggatgggtattgattcctgcatgcacattggctattcttttagtcctaaagttttttgcaaatatccttcatacaagcaatcaagagaaccgattcaaagccattctacggaaaatcaaggaggagtttgaaaaaacaaagggttccatggtttgtgagatctgtaagtacgagtgtgaaacattaaaggaattaaaggcacataatttatcatgtgtgcaaggggagtgcccatattgctttacgcactgtgaaccgacagaaactgcaattcaggcacattacaaagtttgtcaagccacccaccgattcagagaagatttaaaaaagactgtaactcctcaaaatattgggccaggctgttaccgaacattaaatctttttaggtataaaagtaggtgttatattctaacaatgtggactcttcttctcattattgaatccatcctctgggcggcaagtgcagcagaaatccctcttgtccctctctggacagataatgctcatggcgttgggagtgttcctatgcatacggatcttgaattagacttttctttgccatctagctctaagtacacatataaaaggcatctcacaaacccagtcaatgaccaacagagtgtctcattgcatatagaaattgaaagtcaaggcattggtgctgatgtccaccatcttggacattggtatgatgcaaggttaaatctgaaaacctcattccattgttatggtgcctgcacaaaatatcaatatccatggcacactgcaaaatgccattttgagaaagattatgagtatgaaaatagctgggcatgcaaccccccagattgtccaggggttggtacaggttgtactgcctgtggattatatctagatcaattgaagccggtaggaacagcctttaaaattataagtgtaagatatagtagaaaagtgtgcatgcagtttggtgaagaatacctttgcaaaacaattgatatgaatgattgctttgtgactaggcatgccaaaatatgtataattgggactgtatctaagttttctcaaggtgacactctactatttcttggacccatggaaggaggtggtataatctttaaacactggtgtacatctacctgtcactttggagaccctggtgatgtcatgggtccaaaagataaaccatttatttgtcctgaattcccagggcaattcaggaaaaaatgtaactttgccacaactccaatttgtgaatatgatgggaacattatctcaggttataagaaagtccttgcaacaattgattctttccaatcatttaacacaagcaatatacacttcactgatgagagaattgaatggagagaccctgatggtatgcttcgggatcatattaatatcgttatttctaaagatattgattttgaaaatttggctgagaatccttgtaaagtagggctccaggcagcaaacatagaaggtgcttggggttcaggtgtcgggtttacactcacatgccaggtgtctctcacagaatgcccaacatttcttacgtcaataaaggcctgtgacatggcaatttgttatggtgcagaaagtgtgacactttcacgaggacaaaatactgtcaggattactggaagaggtggccatagtggttcttcatttaaatgctgtcatgggaaagaatgttcatcaactggccttcaagccagtgcaccacatttggataaagtaaatggtatctctgagttagaaaacgagaaagtttatgatgatggtgcacctgaatgtggcgttacttgttggtttaaaaaatcaggtgaatgggttatgggtataatcaacgggaactgggttgtcctaattgttttgtgtgtcctgttactcttttctcttatcctgttaagcattttgtgtcctgttagaaagcataaaaaatcataa

SEQ ID NO: 3467 - RNA, 3402 nt, synthetic construct
  misc_feature 1..3402: note = derived and/or modified CDS sequence (wt) from SEOV(K24-v2)__AF288654.1__GP
  source 1..3402: mol_type = other RNA
atgtggagtttgctattactggccgctttagttggccaaggctttgcattaaaaaatgtttttgacatgagaattcagtgtccccactcagtcaactttggggaaacaagtgtgtcaggctatacagaattgcccccactctcattacaagaggcagaacagctagtgccagagagctcatgcaacatggacaaccaccaatcactctcaacaataaataaattaaccaaggtcgtatggcgaaaaaaagcaaatcaggaatcagcaaaccagaattcatttgaagttgtggagagtgaagtcagctttaaagggttatgtatgttaaagcatagaatggttgaagaatcatatagaaacagaagatctgtaatctgttatgatctagcctgtaatagtacattctgtaagccaactgtttacatgattgttcctatacatgcttgcaacatgatgaaaagttgtttgattggccttggtccctacagaattcaggttgtctatgaaaggacatactgcactacgggtatattgacagaaggaaaatgttttgtccccgacacggctgttgtcagtgcattgaagagaggcatgtatgccatagcaagcatagagacaatctgcttctttattcatcagaaagggaatacatataaaatagtgactgccatcacatcagcaatgggctccaagtgcaataatacagatactaaggtccaaggatattatatctgtattattggtggaaactctgctcctgtgtatgcccccgctggtgaagactttagggcaatggaggttttttctgggattattacgtcaccgcatggagatgaccatgacctacctggcgaagaaatcgcaccataccagatttcagggcagatagaggcaaaaatccctcatacagtgagctctaaaaacttgaaattgattgcctttgcaggtattccatcatactcatcaactagtatattggctgcttcagaagacggtcgtttcatatttagtcctggtttatttcctaatttaaatcagtcagtctgtgacaacaatgcacttcctttgatctggaggggcctaattgacttaacgggatactatgaggcagtccacccttgcaatgtattctgtgtcttatcaggaccaggtgcttcatgtgaagccttttcagagggaggtattttcaacattacttctccaatgtgtctggtgtccaagcaaaataggtttagagcagctgagcagcaaatcagctttatttgccaaagggttgatatggatattatagtgtactgtaatgatcaaaaaaagacaatattaacaaaaacattagttataggccagtgcatttatactattacaagtctcttttcactgttaccaggggttgcccattctattgctattgagttgtgtgttccaggttttcatggctgggccacagctgcacttttgatcacattttgctttggatgggtattgattcctgcatgcacattggctattcttttagtcctaaagttttttgcaaatatccttcatacaagcaatcaagagaaccgattcaaagccattctacggaaaatcaaggaggagtttgaaaaaacaaagggttccatggtttgtgagatctgtaagtacgagtgtgaaacattaaaggaattaaaggcacataatttatcatgtgtgcaaggggagtgcccatattgctttacgcactgtgaaccgacagaaactgcaattcaggcacattacaaagtttgtcaagccacccaccgattcagagaagatttaaaaaagactgtaactcctcaaaatattgggccaggctgttaccgaacattaaatctttttaggtataaaagtaggtgttatattctaacaatgtggactcttcttctcattattgaatccatcctctgggcggcaagtgcagcagaaatccctcttgtccctctctggacagataatgctcatggcgttgggagcgttcctatgcatacggatcttgaattagacttttctttgccatctagctctaagtacacatataaaaggcatctcacaaacccagtcaatgaccaacagagtgtctcattgcatatagaaattgaaagtcaaggcattggtgctgatgtccaccatcttggacattggtatggtgcaaggttaaatctgaaaacctcattccattgttatggtgcctgcacaaaatatcaatatccatggcacactgcaaaatgccattttgagaaagattatgagtatgaaaatagctgggcatgcaaccccccagattgtccaggggttggtacaggttgtactgcctgtggattatatctagatcaattgaagccggtaggaacagcctttaaaattataagtgtaagatatagtagaaaagtgtgcatgcagtttggtgaagaatacctttgcaaaacaattgatatgaatgattgctttgtgactaggcatgccaaaatatgtataattgggactgtatctaagttttctcaaggtgacactctactatttcttggacccatggaaggaggtggtataatctttaaacactggtgtacatctacctgtcactttggagaccctggtgatgtcatgggtccaaaagataaaccatttatttgtcctgaattcccagggcaattcaggaaaaaatgtaactttgccacaactccaatttgtgaatatgatgggaacattatctcaggttataagaaagtccttgcaacaattgattctttccaatcatttaacacaagcaatatacacttcactgatgagagaattgaatggagagaccctgatggtatgcttcgggatcatattaatatcgttatttctaaagatattgattttgaaaatttggctgagaatccttgtaaagtagggctccaggcagcaaacatagaaggtgcttggggttcaggtgtcgggtttacactcacatgccaggtgtctctcacagaatgcccaacatttcttacgtcaataaaggcctgtgacatggcaatttgttatggtgcagaaagtgtgacactttcacgaggacaaaatactgtcaggattactggaaaaggtggccatagtggttcttcatttaaatgctgtcatgggaaagaatgttcatcaactggccttcaagccagtgcaccacatttggataaagtaaatggtatctctgagttagaaaacgagaaagtttatgatgatggtgcacctgaatgtggcgttacttgttggtttaaaaaatcaggtgaatgggttatgggtataatcaacgggaactgggttgtcctaattgttttgtgtgtcctgttactcttttctcttatcctgttaagcattttgtgtcctgttagaaagcataaaaaatcataa

SEQ ID NO: 3468 - RNA, 3402 nt, synthetic construct
  misc_feature 1..3402: note = derived and/or modified CDS sequence (wt) from SEOV(KI-83-262)__D17592.1__GP
  source 1..3402: mol_type = other RNA
atgtggagtttgctattactggccgctctagttggccaaggttttgcattgaaaaatgtatttgacatgagaattcagtgtccccactcagtcaactttggggaaacaagtgtgtcaggctatacagaattgcccccactctcattacaggaggcagaacagctagtgccagagagctcatgcaacatggacaaccaccaatcactctcaacaataaataaattaaccaaggtcatatggcggaaaaaagcaaatcaggaatcagcaaaccagaattcatttgaagttgtggaaagtgaagtcagctttaaagggttgtgtatgttaaagcataggatggttgaagaatcatatagaaataggagatcagtaatctgttatgatctagcctgtaatagtacattctgtaagccaactgtctacatgattgttcctatacatgcttgcaacatgatgaaaagctgtttgattggccttggcccctacagaatccaggttgtctatgaaaggacatactgcactacgggtatattgacagaaggaaaatgttttgtccctgacaaggctgttgtcagtgcattgaaaagaggcatgtatgctatagcaagcatagagacaatctgcttttttattcatcagaaagggaatacatataagatagtgactgccattacatcggcaatgggctccaaatgtaataatacagatactaaagttcaaggatattatatctgtattattggtggaaactccgcccctgtatatgcccctgctggtgaagacttcagggcaatggaggttttctctgggattattacatcaccgcatggagaagaccatgacctacccggcgaagaaatagcaacgtaccagatttcagggcagatagaggcaaaaatccctcatacagtgagctccaagaatttaaaattgactgcttttgcaggtattccatcatactcatcaactagtatattggctgcttcagaagatggtcgtttcatatttagtcctggtttatttcctaacctaaatcagtcagtctgtgacaacaatgcactccctttaatctggaggggcctaattgatttaacaggatactatgaggcagtccacccttgcaatgtgttctgtgtcttatcaggaccaggtgcttcatgtgaggccttttcagaaggaggtattttcaatattacctctccaatgtgtctggtgtccaagcaaaataggtttagagcagctgagcagcagattagctttgtctgccaaagagttgatatggatattatagtgtactgtaatggtcagaaaaaaacaatcctaacaaaaacattagttataggccaatgtatttatactattacaagtctcttttcactgttaccaggggttgcccattctattgctattgagttgtgtgttccaggatttcatggctgggccacagctgcacttttgattacattctgcttcggctgggtattaattcctgcatgtacattagctattcttttagtccttaagttttttgcaaatatccttcatacaagcaatcaagagaaccgattcaaagccattctacggaaaataaaggaggagtttgaaaaaacaaagggttccatggtttgtgagatttgtaagtatgagtgtgaaacattaaaggaattgaaggcacataatctatcatgtgttcaaggggagtgcccatattgctttacccactgtgaaccgacagaaactgcaattcaggcacattacaaagtttgtcaagccacccaccgattcagagaagatttaaagaagactgtcactcctcaaaatatcgggccaggctgttaccgaacactaagtctttttaggtataaaagtagatgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttctctttgccatccagttctaagtacacatataaaagacatctcacaaacccagttaatgaccaacagagtgtctcactgcacatagaaattgaaagtcaaggcattggtgctgatgttcatcatctcggacattggtatgatgcaagattgaatttaaaaacctcatttcattgttatggtgcctgcacaaaatatcaatacccatggcacactgcaaaatgccattttgagaaagattatgagtatgaaaatagctgggcttgcaaccccccagattgcccaggggttggtacaggttgtactgcttgtggattatatctagatcaattgaagccggtaggaacagcctttaaaattataagtgtaagatacagtagaaaagtgtgcgtgcagtttggtgaagaatacctttgtaaaacaattgatatgaatgattgctttgtgaccaggcatgccaaaatatgtataattgggactgtatctaagttttctcaaggtgacactctactatttctggggcccatggaaggaggtggtataatctttaaacactggtgtacatctacctgtcactttggagaccctggtgatgtcatgggtccaaaagataaaccgtttatttgccctgaattcccagggcaatttaggaaaaaatgtaactttgccacaactccagtttgtgaatatgatggaaacattatatcgggttataagaaagtacttgcaacaattgattctttccaatcatttaacacaagcaatatacacttcactgatgagagaattgaatggagagaccctgatggcatgcttcgggatcatattaatatcgttatttctaaagatattgattttgaaaacttggctgagaatccttgtaaagtagggctccaggcagcaaacatagaaggtgcctggggttcaggtgtcgggtttacactcacatgccaggtgtctctcacagaatgcccaacatttcttacatcaataaaggcctgtgacatggcaatttgttatggtgcagaaagtgtgacactatcacgaggacaaaatactgtcaaaattaccgggaaaggtggccatagtggttcttcatttaaatgctgtcatgggaaagaatgttcatcaactggcctccaagctagtgcaccacatctggataaggtaaatggtatctctgagttagaaaacgagaaagtttatgatgacggtgcacctgaatgtggcattacttgttggtttaaaaaatcaggtgaatgggttatgggtataatcaatgggaactgggttgtcctaattgtcttgtgtgtcctgctgctcttttctcttatcctgttgagcatcttgtgtcctgttagaaagcataaaaaatcataa

SEQ ID NO: 3469 - RNA, 3402 nt, synthetic construct
  misc_feature 1..3402: note = derived and/or modified CDS sequence (wt) from SEOV(KI-85-1)__D17593.1__GP
  source 1..3402: mol_type = other RNA
atgtggagtttgctattactggccgctctagttggccaaggttttgcattgaaaaatgtatttgacatgagaattcagtgtccccactcagtcaactttggggaaacaagtgtgtcaggctatacagaattgcccccactctcattacaggaggcagaacagctagtgccagagagctcatgcaacatggacaaccaccaatcactctcaacaataaataaattaaccaaggtcatatggcggaaaaaagcaaatcaggaatcagcaaaccagaattcatttgaagttgtggaaagtgaagtcagctttaaagggttgtgtatgttaaagcataggatggttgaagaatcatatagaaataggagatcagtaatctgttatgatctagcctgtaatagtacattctgtaagccaactgtctacatgattgttcctatacatgcttgcaacatgatgaaaagctgtttgattggccttggcccctacagaatccaggttgtctatgaaaggacatactgcactacgggtatattgacagaaggaaaatgttttgtccctgacaaggctgttgtcagtgcattgaaaagaggcatgtatgctatagcaagcatagagacaatctgcttttttattcatcaaaaagggaatacatataagatagtgactgccattacatcggcaatgggctccaaatgtaataatacagatactaaagttcaaggatattatatctgtattattggtggaaactccgcccctgtatatgcccctgctggtgaagacttcagggcaatggaggttttctctgggattattacatcaccgcatggagaagaccatgacctacccggcgaagaaatagcaacgtaccagatttcagggcagatagaggcaaaaatccctcatacagtgagctccaagaatttaaaattgactgcttttgcaggtattccatcatactcatcaactagtatattggctgcttcagaagatggtcgtttcatatttagtcctggtttatttcctaacctaaatcagtcagtctgtgacaacaatgcactccctttaatctggaggggcctaattgatttaacaggatactatgaggcagtccacccttgcaatgtgttctgtgtcttatcaggaccaggtgcttcatgtgaggccttttcagaaggaggtattttcaatattacctctccaatgtgtctggtgtccaagcaaaataggtttagagcagctgagcagcagattagctttgtctgccaaagagttgatatggatattatagtgtactgtaatggtcagaaaaaaacaatcctaacaaaaacattagttataggccaatgtatttatactattacaagcctcttttcactgttaccaggggttgcccattctattgctattgagttgtgtgttccaggatttcatggctgggccacagctgcacttttgattacattctgcttcggctgggtattaattcctgcatgtacattagctattcttttagtccttaagttttttgcaaatatccttcatacaagcaatcaagagaaccgattcaaagccattctacggaaaataaaggaggagtttgaaaaaacaaagggttccatggtttgtgagatttgtaagtatgagtgtgaaacattaaaggaattgaaggcacataatctatcatgtgttcaaggggagtgcccatattgctttacccactgtgaaccgacagaaactgcaattcaggcacattacaaagtttgtcaagccacccaccgattcagagaagatttaaagaagactgtcactcctcaaaatatcgggccaggctgttaccgaacactaaatctttttaggtataaaagtagatgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttctctttgccatccagttctaagtacacatataaaagacatctcacaaacccagttaatgaccaacagagtgtctcactgcacatagaaattgaaagtcaaggcattggtgctgatgttcatcatctcggacattggtatgatgcaagattgaatttaaaaacctcatttcattgttatggtgcctgcgcaaaatatcaatacccatggcacactgcaaaatgccattttgagaaagattatgagtatgaaaatagctgggcttgcaaccccccagattgcccaggggttggtacaggttgtactgcttgtggattatatctagatcaattgaagccggtaggaacagcctttaaaattataagtgtaagatacagtagaaaagtgtgcgtgcagtttggtgaagaatacctttgtaaaacaattgatatgaatgattgctttgtgaccaggcatgccaaaatatgtataattgggactgtatctaagttttctcaaggtgacactctactatttctggggcccatggaaggaggtggtataatctttaaacactggtgtacatctacctgtcactttggagaccctggtgatgtcatgggtccaaaagataaaccgtttatttgccctgaattcccagggcaatttaggaaaaaatgtaactttgccacaactccagtttgtgaatatgatggaaacattatatcgggttataagaaagtacttgcaacaattgattctttccaatcatttaacacaagcaatatacacttcactgatgagagaattgaatggagagaccctgatggcatgcttcgggatcatattaatatcgttatttctaaagatattgattttgaaaacttggctgagaatccttgtaaagtagggctccaggcagcaaacatagaaggtgcctggggttcaggtgtcgggtttacactcacatgccaggtgtctctcacagaatgcccaacatttcttacatcaataaaggcctgtgacatggcaatttgttatggtgcagaaagtgtgacactgtcacgaggacaaaatactgtcaaaattaccgggaaaggtggccatagtggttcttcatttaaatgctgtcatgggaaagaatgttcatcaactggcctccaagctagtgcaccacatctggataaggtaaatggtatctctgagttagaaaacgagaaagtttatgatgacggcgcacctgaatgtggcattacttgttggtttaaaaaatcaggtgaatgggttatgggtataatcaatgggaactgggttgtcctaattgtcttgtgtgtcctgctgctcttttcttttatcctgttgagcatcttgtgtcctgttagaaagcataaaaaatcataa

SEQ ID NO: 3470 - RNA, 3402 nt, synthetic construct
  misc_feature 1..3402: note = derived and/or modified CDS sequence (wt) from SEOV(KI-88-15)__D17594.1__GP
  source 1..3402: mol_type = other RNA
atgtggagtttgctattactggccgctctagttggccaaggttttgcattgaaaaatgtatttgacatgagaattcagtgtccccactcagtcaactttggggaaacaagtgtgtcaggctatacagaattgcccccactctcattacaggaggcagaacagctagtgccagagagctcatgcaacatggacaaccaccaatcactctcaacaataaataaattaaccaaggtcatatggcggaaaaaagcaaatcaggaatcagcaaaccagaattcatttgaaattgtggaaagtgaagtcagctttaaagggttgtgtatgttaaagcataggatggttgaagaatcatatagaaataggagatcagtaatctgttatgatctagcctgtaatagtacattctgtaagccaactgtctacatgattgttcctatacatgcttgcaacatgatgaaaagctgtttgattggccttggcccctacagaatccaggttgtctatgaaaggacatactgcactacgggtatattgacagaaggaaaatgttttgtccctgacaaggctgttgtcagtgcattgaaaagaggcatgtatgctatagcaagcatagagacaatctgcttttttattcatcagaaagggaatacatataagatagtgactgccattacatcggcaatgggctccaaatgtaataatacagatactaaagttcaaggatattatatctgtattattggtggaaactccgcccctgtatatgcccctgctggtgaagacttcagggcaatggaggttttctctgggattattacatcaccgcatggagaagaccatgacctacccggcgaagaaatagcaacgtaccagatttcagggcagatagaggcaaaaatccctcatacagtgagctccaagaatttaaaattgactgcttttgcaggtattccatcatactcatcaactagtatattggctgcttcagaagatggtcgtttcatatttagtcctggtttatttcctaacctaaatcagtcagtctgtgacaacaatgcactccctttaatctggaggggcctaattgatttaacaggatactatgaggcagtccacccttgcaatgtgttctgtgtcttatcaggaccaggtgcttcatgtgaggccttttcagaaggaggtattttcaatattacctctccaatgtgtctggtgtccaagcaaaataggtttagagcagctgagcagcagattagctttgtctgccaaagagttgatatggatattatagtgtactgtaatggtcagaaaaaaacaatcctaacaaaaacattagttataggccaatgtatttatactattacaagcctcttttcactgttaccaggggttgcccattctattgctattgagttgtgtgttccaggatttcatggctgggccacagctgcacttttgattacattctgcttcggctgggtattaattcctgcatgtacattagctattcttttagtccttaagttttttgcaaatatccttcatacaagcaatcaagagaaccgattcaaagccattctacggaaaataaaggaggagtttgaaaaaacaaagggttccatggtttgtgagatttgtaagtatgagtgtgaaacattaaaggaattgaaggcacataatctatcatgtgttcaaggggagtgcccatattgctttacccactgtgaaccgacagaaactgcaattcaggcacattacaaagtttgtcaagccacccaccgattcagagaagatttaaagaagactgtcactcctcaaaatatcgggccaggctgttaccgaacactaaatctttttaggtataaaagtagatgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttctctttgccatccagttctaaatacacatataaaagacatctcacaaacccagttaatgaccaacagagtgtctcactgcacatagaaattgaaagtcaaggcattggtgctgatgttcatcatctcggacattggtatgatgcaagattgaatttaaaaacctcatttcattgttatggtgcctgcacaaaatatcaatacccatggcacactgcaaaatgccattttgagaaagattatgagtatgaaaatagctgggcttgcaaccccccagattgcccaggggttggtacaggttgtactgcttgtggattatatctagatcaattgaagccggtaggaacagcctttaaaattataagtgtaagatacagtagaaaagtgtgcgtgcagtttggtgaagaatacctttgtaaaacaattgatatgaatgattgctttgtgaccaggcatgccaaaatatgtataattgggactgtatctaagttttctcaaggtgacactctactatttctggggcccatggaaggaggtggtataatctttaaacactggtgtacatctacctgtcactttggagaccctggtgatgtcatgggtccaaaagataaaccgtttatttgccctgaattcccagggcaatttaggaaaaaatgtaactttgccacaactccagtttgtgaatatgatggaaacattatatcgggttataagaaagtacttgcaacaattgattctttccaatcatttaacacaagcaatatacacttcactgatgagagaattgaatggagagaccctgatggcatgcttcgggatcatattaatatcgttatttctaaagatattgattttgaaaacttggctgagaatccttgtaaagtagggctccaggcagcaaacatagaaggtgcctggggttcaggtgtcgggtttacactcacatgccaggtgtctctcacagaatgcccaacatttcttacatcaataaaggcctgtgacatggcaatttgttatggtgcagaaagtgtgacactgtcacgaggacaaaatactgtcaaaattaccgggaaaggtggccatagtggttcttcatttaaatgctgtcatgggaaagaatgttcatcaactggcctccaagctagtgcaccacatctggataaggtaaatggtatctctgagttaaaaaacgagaaagtttatgatgacggcgcacctgaatgtggcattacttgttggtttaaaaaatcaggtgaatgggttatgggtataatcaatgggaactgggttgtcctaattgtcttgtgtgtcctgctgctcttttcttttatcctgttgagcatcttgtgtcctgttagaaagcataaaaaatcataa

SEQ ID NO: 3471 - RNA, 3402 nt, synthetic construct
  misc_feature 1..3402: note = derived and/or modified CDS sequence (wt) from SEOV(LongwanRn581)__GU592930.1__GP
  source 1..3402: mol_type = other RNA
atgtggagtttgctattactggccgctttagttggccaaggctttgcattaaaaaatgtgtttgacatgagaatccagtgtccccactcagtcaactttggggaaacaagtgtgtcaggctatacagaattgccaccactctcattacaggaggcagaacaactagtgccagagagctcatgcaacatggacaaccaccaatcactctcaacaataaataaattaaccaaggtaatatggcggaaaaaagcaaatcaggaatcagcaaaccagaattcatttgaagttgtggagagtgaagtcagctttaaaggattgtgtatgttaaagcatagaatggttgaagaatcatatagaaacaggagatcagtaatctgttatgatctagcctgtaatagtacattctgtaagccaactgtttacatgattgtccctatacatgcatgcaacatgatgaaaagctgtttgattggccttggtccctacagaatccaggttgtctatgaaaggacatactgcactacgggtatattgacagaaggaaagtgctttgtccccgacaaggctgttgtcagtgcattgaagagaggcatgtatgccatagcgagcatagagacaatctgcttttttattcatcagaaagggaatacatataagatagtgactgccattacatcagcgatgggctccaaatgtaataatacagatactaaagttcagggatattatatctgcattattggtggaaactccgcccctgtatatgctcctgctggtgaagactttagggcaatggaggttttttctgggattattacatcaccgcatggagaagaccatgacctccctggcgaagaaatcgcaacataccagatttcagggcagatagaggcaaaaatccctcatacagtaagctctaaaaacttaaaattgactgcttttgcaggtattccatcatactcatcaactagtatattggctgcttcagaagatggtcgttttatatttagtcctggtttatttcctaatctaaatcagtcagtctgtgataacaatgcactccctttaatctggaggggtctaattgatttaacgggatactatgaggcagtccacccttgcaatgtattctgtgtcttatcaggaccaggtgcttcatgtgaagccttttcagaaggaggtattttcaatattacttctccaatgtgtttggtgtccaagcaaaataggtttagagcagctgagcagcagatcagctttgtctgccaaagggtcgatatggatattatagtgtactgtaatggtcaaaaaaagacaatcctaacaaaaacattagttataggccaatgtatttatactattacaagtctcttttcactgttgccaggggttgcccattctattgctattgagttgtgtgttccagggttccatggctgggccacagctgcacttttgatcacattttgctttggctgggtattaattcctgcatgtacattagctattcttctagttcttaagttttttgcaaatatccttcatacaagcaatcaagagaatcgattcaaagccattctacggaaaataaaggaggagtttgaaaaaacaaagggttctatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtgtgtcaagccacccaccgattcagagaagatttaaaaaagactgtaactcctcaaaatattggcccaggctgttaccgaacattgaatcttttcaggtataaaagtaggtgttatattcttacaatgtggactcttctcctcattattgaatccatcctctgggcagcaagtgcagcagaaatcccccttgtccctctctggacagataatgctcatggtgttgggagtgttcccatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttgggcattggtatgatgcaagattgaatctaaaaacctcatttcattgctatggtgcctgcacaaagtaccaatatccatggcacaccgcaaaatgtcattttgagaaggattatgagtatgaaaatagttgggcatgcaaccctccagattgcccaggggttggtacaggttgtactgcatgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaagatatgtataattgggactgtatctaagttttctcaaggtgacacactactatttcttgggcccatggaaggaggtggtataatcttcaaacactggtgtacatctacctgtcactttggagaccctggtgatgttatgggtccaaaagataaaccatttatttgccctgaattcccagggcaattcaggaagaaatgtaattttgccacaactccagtatgtgaatatgatgggaacattatttcaggctataaaaaagtccttgcaacaattgattctttccaatcatttaacacaagcaatatacacttcactgatgagagaattgaatggagagaccctgatggtatgcttcgggatcatattaatattgttatttctaaagatattgattttgaaaatttggccgagaatccttgtaaagtagggctccaggcagcaaacatagaaggtgcttggggttcaggtgtcggttttacactcacatgccaggtgtctctcacagaatgcccaacatttctcacgtcaataaaggcctgtgacatggcaatttgttatggtgcagaaagtgttacactttcacgaggacaaaatactgtcaaaattaccgggaaaggtggccatagtggctcttcgtttaaatgctgtcatgggaaagaatgttcatcaactggccttcaagccaatgcaccacatctggataaggtaaatggtatctccgagttagaaaacgagaaagtttatgatgatggtgcacctgaatgtggcgttacttgttggtttaaaaaatcaggtgaatgggttatgggtataatcaatgggaactgggttgtcctaattgttttgtgtgtcctgctgctcttttctctcatcttgttgagcatcttgtgtcctgttagaaagcataaaaaatcataa

SEQ ID NO: 3472 - RNA, 3402 nt, synthetic construct
  misc_feature 1..3402: note = derived and/or modified CDS sequence (wt) from SEOV(RuianRn180)__GU592931.1__GP
  source 1..3402: mol_type = other RNA
atgtggagtttgctaatcgtggccgctttagttggccaaggctttgcattaaaaaatgtgtttgacatgagaattcagtgtccccactcagtcaactttggggagacaagtgtgtcaggctatacagaattgcccccactctcattacaggaggcagaacagctggtgccagagagctcatgcaacatggacaaccaccaatcactctcaacaataaataaattaaccaaggtaatatggcggaaaaaagcaaatcaggaatcagcaaaccagaattcatttgaagttgtggagagtgaagtcagctttaaagggttgtgtatgttaaagcatagaatggttgaagaatcatatagaaacaggcgatcagtaatctgttatgatctagcctgtaatagtacattctgtaagccaactgtttacatgattgttcctatacatgcttgcaacatgatgaaaagctgtttgattggcctcggtccctacagaattcaggttgtctacgaaaggacatactgcactacgggtatattgacagaaggaaagtgctttgtccccgacaaggctgttgtcagtgcgctgaagagaggcatgtatgccatagcaagcatagagacaatctgcttttttattcatcagaaagggaatacatataagatagtgactgccattacatcagcaatgggctccaaatgcaataatacagatactaaagttcagggatattatatctgtattattggtggaaactctgcccctgtatatgcccctgctggtgaagactttagggcaatggaggttttttctgggattattacatcacctcatggagaagaccatgacctccctggcgaagaaatcgcaacataccagatttcagggcagatagaggcaaaaatccctcatacagtgagctctaaaaacttaaaattgactgcttttgcaggtattccatcatactcatcaactagtatattagctgcttcagaagatggtcgtttcatatttagtcctggtttatttcctaacctaaatcagtcagtctgtgataacaatgcactccctttaatctggaggggcctaattgatttaacgggatactatgaggcagtccacccttgtaatgtgttctgtgtcttatcaggaccaggtgcttcatgtgaagccttttcagaaggaggtattttcaatattacttctccaatgtgtctggtgtccaagcaaaataggtttagagcagctgagcagcagatcagctttatttgccaaagggtcgatatggatatcatagtgtactgtaatggtcaaaaaaagacaatcctaacaaaaacattagttataggccaatgtatttatactattacaagtctcttttcactgttgccaggggttgcccattctattgctattgagttgtgtgttccaggttttcatggctgggccacagctgcacttttgatcacattctgctttggctgggtattgattcctgcatgtacattagctattcttctagttctcaagttttttgcaaatatccttcatacaagcaatcaagagaatcgattcaaagccattctacggaaaataaaggaggagtttgaaaaaacaaagggttccatggtttgtgaaatctgtaagtatgagtgtgaaacattaaaggaattgaaggcacataatctatcatgtgttcaaggggagtgcccatattgttttacccactgtgaaccgacagaaactgcaattcaggcacattacaaagtttgtcaagccacccaccgatttagagaggatttaaaaaagactgtaactcctcaaaatattgggccaggctgttaccgaacattgaatcttttcaggtataaaagtaggtgctatattctgacaatgtggactcttcttctcattattgaatccatcctctgggcagcaagtgcagcagaaatcccccttgtcccactctggacagataatgctcatggcgttgggagtgttcctatgcatacagatcttgaattagacttttctttgccatctagttctaagtatacatataaaaggcatcttacaaacccagttaatgaccaacagagtgtctcattgcatatagaaattgaaagtcaaggcattggtgctgatgttcatcatcttggacattggtatgatgcaagattgaatctaaaaacctcatttcattgctatggtgcctgcacaaagtaccaatatccatggcacactgcaaaatgccattttgagaaggattatgagtatgaaaatagttgggcatgcaaccccccagattgcccaggggttggtacaggttgtactgcttgtggattatacctagatcagttgaagccggtaggaacagccttcaaaattataagtgtacgatacagtagaaaagtgtgcgtgcagtttggtgaagaatacctttgcaaaacaattgacatgaacgattgctttgtgactaggcatgccaaaatatgtataattgggactgtatctaagttctctcaaggtgacactctactatttcttgggcccatggaaggaggtggtataatctttaaacactggtgtacatctacctgtcactttggagaccctggtgatgttatgggtccaaaagataaaccatttatttgccctgaatttccagggcaattcaggaagaaatgtaattttgccacaactccagtttgtgaatatgatgggaacattatttcaggctataaaaaagttcttgcaacaattgattctttccaatcattcaacacaagcaatatacatttcactgatgagagaattgaatggagagaccctgacggtatgcttcgggatcatatcaatattgttatttctaaagatattgattttgaaaatttagccgagaacccttgtaaagtagggctccaggcagccaatatagaaggtgcttggggttcaggtgttgggtttacactcacatgccaggtgtctctcacagaatgcccaacatttctcacatcaataaaggcctgtgacatggcaatttgttatggtgcagaaagtgtgacactctcacgaggacaaaatactgtcaaaattaccgggaaaggtggccatagtggttcttcatttaaatgctgtcatgggaaagaatgttcatcaactgggcttcaagccagtgcaccacatctagataaggtaaatggtatctctgagttggaaaacgagaaagtttatgatgatggtgcacctgaatgtggtgttacttgttggtttaaaaaatcaggtgaatgggttatgggtataatcaatgggaactgggttgtcctaattgttttgtgtgtcctgctgctcttttctcttatcctgttgagcatcttgtgtcctgttagaaagcataaaaaatcataa

SEQ ID NO: 3473 - RNA, 3402 nt, synthetic construct
  misc_feature 1..3402: note = derived and/or modified CDS sequence (wt) from SEOV(ShuangyangRn470)__GU592925.1__GP
  source 1..3402: mol_type = other RNA
atgtggagtttgctattcttggccgctttagttggccaaggctttgcattaaaaaatgtgtttgacatgagaatacagtgtccccactcagtcaactttggggaaacaagtgtgtcagggtatacagagttgcccccactctcattacaggagtcagaacagctagtgccagagagctcatgcaacatggataaccaccaatcactctcaacaataaataaattaaccaaggtaatatggcggaaaaaagcaaatcaggaatcagcaaaccagaattcatttgaagttgtagagagtgaagtcagctttaaagggttgtgtatgttaaagcatagaatggttgaagaatcatatagaaacagaagatcagtaatctgttatgatctagcctgtaatagtacattctgtaagccaactgtttacatgattgttcctatacatgcttgcaacatgatgaaaagctgtttgattggccttggtccctacagaatccaggttgtctacgaaaggacatactgcactacgggtatattgacagaaggaaagtgttttgtccctgacaaggctgttgttagtgcattgaagagaggcatgtatgccatagcaagcatagaaacaatctgcttttttattcatcagaaagggaatacatataagatagtgactgccatcacatcagcgatgggctccaaatgtaataatacagatactaaagttcagggatattatatctgtattattggtggaaactctgcccctgtatatgcccctgctggtgaagactttagggcaatggaggttttttctgggattattacgtcaccgcatggagaagaccatgacctccctggcgaagaaattgcaacataccagatctcagggcagatagaggcaaaaatccctcatacagtgagctctaaaaacttaaaattgactgcttttgcaggtattccatcatactcatcaactagtatattagctgcttcagaagacggtcgtttcatatttagtcctggtttatttcctaacctaaatcagtcagtctgtaacaacaatgcactccctttaatctggaggggcctaattgatttaacgggatactatgaggcagtccacccttgcaatgtattttgtgtcttatcaggaccaggtgcttcatgtgaagccttttcagaaggaggtattttcaatattacttctccaatgtgtctggtgtccaagcaaaataggtttagagcagctgagcagcagatcagctttgtctgccaaagggtcgatatggatattatagtgtactgtaatggtcaaaaaaagacaatcctaacaaaaacattagttatagggcaatgtatttacactattacaagtctcttttcactgttgccaggggttgcccattctattgctattgagttgtgtgttccagggtttcatggctgggccacagctgcacttttgatcacattctgctttggctgggtattgattcctgcatgtacattagctattcttctagtcctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatttatcatgtgttcaaggggagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacattgaatcttttcaggtataaaagtaggtgttatattctgacaatgtggactcttcttctcattgttgaatccatcctctgggcagcaagtgcagcagaaatcccccttgtccctctctggacagataatgctcatggcgttgggagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagactgaatctaaaaacctcatttcattgctatggtgcctgcacaaaataccaatatccatggcacactgcaaaatgccattttgagaaagattatgagtatgaaaatagttgggcatgcaaccccccagattgcccaggggttggtacaggttgtactgcttgtggattgtatctagatcaattgaagccggtaggaacagccttcaaaattataagtgtaagatacagtagaaaagtatgcgtgcagtttggtgaagaatacctttgcaaaacaattgatatgaatgattgctttgtgactaggcatgccaaaatatgtataattgggactgtatctaagttctctcaaggtgacactctactatttcttgggcccatggaaggaggtggtataatctttaaacactggtgcacatctacctgtcattttggagaccctggtgatgtcatgggtcctaaggataaaccatttatttgccctgaattcccagggcagttcaggaagacatgtaattttgccacaactccagtttgtgaatatgatgggaacattatttcaggctataagaaagttcttgcaacaattgattctttccaatcatttaacacaagcaatatacacttcactgatgagagaattgaatggagagaccctgatggtatgcttcgggatcatatcaatattgttatttctaaagatattgattttgaaaatttggccgagaatccttgtaaagtagggctccaggcagcaaacatagaaggtgcttggggttcaggtgtcgggtttacactcacatgccaggtgtccctcacagaatgcccaacatttctcacgtcaataaaggcctgtgacatggcaatttgttatggtgcagaaagtgtgacactatcacgaggacaaaatactgtaaaaattactgggaaaggtggccatagtggttcatcatttaaatgctgtcatgggaaggagtgttcatcaactggccttcaagccagtgcaccacatctggacaaggtaaatggtatctctgagttagagaacgagaaagtttatgatgacggtgcacctgaatgtggcgttacttgttggtttaagaaatcaggtgaatgggttatgggtataatcaatgggaactgggttgtcctaattgttttgtgtgtcctgctgctcttttctcttatcctgttaagcatcttgtgccctgttagaaagcataaaaaatcataa

SEQ ID NO: 3474 - RNA, 3402 nt, synthetic construct
  misc_feature 1..3402: note = derived and/or modified CDS sequence (wt) from SEOV(WuhanMm13)__JQ665886.1__GP
  source 1..3402: mol_type = other RNA
atgtggagtttgctattactggccgctttagttggccaaggctttgcattaaaaaatgtatttgacatgagaatccagtgtccccactcagtcaactttggggaaacaagtgtgtcaggctatacagaattgcccccactctcattacaggaggctgaacagctagtgccagagagctcatgtaacatggacaaccaccaatcactctcaacaataaataaattaaccaaggtcatatggcggaaaaaagcaaatcaggaatcagcgaaccagaattcttttgaagttatagagagtgaagtcagctttaaagggttgtgtatgttaaagcatagaatggttgaagaatcatatagaaacaggagatcagtgatctgttatgatctagcctgtaatagcacattctgtaagccaactgtttacatgattgttcctatacatgcctgcaacatgatgaaaagctgtttgattggccttggtccctacagaatccaggttgtctatgaaaggacatactgcactacaggtatattgacagaaggaaaatgctttgtccccgacaaggctgttgttagtgcattgaagagaggcatgtatgccgtagcaagcatagagacaatctgcttttttattcatcagaaaggaaatacatataagatagtgactgccattacatcagcaatgggctccaaatgtaataatacagatactaaagttcaaggatattacatctgtattattggtggaaactccgcccctgtatatgcccctgctggtgaagactttagggcaatggaggttttttctgggattattacatcaccacatggagaagaccatgacctccctggcgaagaaattgcaacataccagatttcagggcagatagaggcaaaaatccctcatactgtgagctctaaaaacttaaaattaactgcttttgcaggtattccatcatactcatcaactagtatattggctgcttcagaagatggtcgtttcatattcagccctggtttgtttcccaacctaaatcagtcagtctgtgacaacaatgcactccctttaatctggaggggcctaattgatttaacaggatactatgaggcagtccacccttgcaatgtattctgtgtcttatcaggaccaggtgcttcatgtgaagccttttcagagggaggtattttcaatattacttctccaatgtgtctggtgtccaagcaaaataggtttcgagcagctgagcagcagattagctttgtctgtcaaagggttgatatggatattatagtatactgtaatggtcaaaaaaagacaatcctaacaaaaacattagttataggccagtgtatttatactattacaagtctcttttcactgttaccaggggtggcccattctattgctattgagttgtgtgttccaggtttccatggctgggccacagctgcacttttaactacattctgctttggctgggtattaattcctgcatgtacattagctattcttttagttcttaagttttttgcaaacatccttcatacaagcaatcaagagaaccgattcaaagccattctacgtaaaataaaggaggagtttgaaaaaacaaagggttccatggtttgtgagatctgtaaatatgagtgtgaaacattaaaggaattaaaggcacataatctatcatgtgttcaaggggagtgcccatattgctttacccactgtgaaccgacagaaactgcaattcaggcacattacaaagtttgtcaagccacccatcgattcagagaagatttaaaaaagactgtaactcctcaaaatatcgggccgggctgttaccgaacattaaatctttttaggtataaaagtagatgttatattctgacaatgtggactattcttctcattattgaatccatcctctgggcggcaagtgcagcagaaatcccccttgtccctctctggacagataatgctcatggcgtcgggagtgttcctatgcatacagatcttgaattagacttttctttgccatccagttctaaatacacatataaaagacatctcacaaacccagttaatgaccaacagagtgtctcattgcatatagaaattgaaagtcaaggtattggtgctgatgttcatcatcttggacattggtatgatgcaagattgaatctaaaaacctcatttcattgttatggtgcctgcacaaaatatcaatatccatggcacactgcaaaatgtcattttgagaaagattatgagtatgaaaatagctgggcatgcaaccccccagattgcccaggggttggtacaggttgtactgcttgtggattatatttagatcaattgaagccagtaggaacagccttcaaaattataagtgtgagatacagtagaaaagtgtgtgtgcagtttggtgaagaatacctttgtaaaacaattgatatgaatgattgctttgtgactaggcatgctaaaatatgtataattgggactgtatctaagttttctcaaggtgacactctactatttcttgggcccatggaaggaggtggtataatctttaaacactggtgtacatcgacttgtcactttggagaccctggtgatgtcatgggtccaaaagataaaccatttatttgccctgaattcccagggcaatttaggaaaaaatgtaactttgccacaactccggtttgtgaatatgatgggaatattatctcaggttataagaaagttcttgcaacaattgattctttccaatcatttaacacaagcaatatacacttcactgatgagagaattgaatggagagaccctgatggtatgcttcgggatcatattaacatcgttatttctaaagatattgattttgaaaatttggctgagaatccttgtaaagtagggctccaggcagcaaacatagaaggtgcttggggttcaggtgtcgggtttacacttacatgccaggtgtctctcacagaatgcccaacatttctcacgtcaataaaggcctgtgatatggcaatttgttatggtgcagaaagtgtgacactctcacgaggacaaaacactgtcaaaattaccgggaaaggtggccatagtggttcttcatttaaatgctgtcatggaaaagaatgttcatcaactggcctccaagccagtgcaccgcatctggataaggtaaatggtatatctgagttagaaaacgagaaagtttatgatgatggtgcaccagaatgtggcattacttgttggtttaagaaatcaggtgagtgggttatgggtataatcaatggaaactgggttgtcctaattgctttgtgtgtcctgttgcttttttctcttatcctgttaagcattttgtgtcctgttagaaagcataaaaaatcataa

SEQ ID NO: 3475 - RNA, 3402 nt, synthetic construct
  misc_feature 1..3402: note = derived and/or modified CDS sequence (wt) from SEOV(WuhanMm24)__JQ665887.1__GP
  source 1..3402: mol_type = other RNA
atgtggagtttgctattactggccgctttagttggccaaggctttgcattaaaaaatgtatttgacatgagaattcagtgcccccactcagtcaactttggggaaacaagtgtgtcaggctacacagaactgcccccactctcattacaggaggcagaacagctagtgccagagagctcatgcaacatggacaaccaccaatcactctcaacaataaataaattaaccaaggtcatatggcggaaaaaggcaaatcaggaatcagcaaaccagaattcatttgaagttatggagagtgaagtcagctttaaagggttgtgtatgttaaagcatagaatggttgaagaatcatacagaaataggagatcagtaatctgttatgatctagcctgtaatagtacattctgtaagccaactgtctacatgattgttcctatacatgcatgcaacatgatgaaaagctgtttgattggtcttggtccttacagaatccaggttgtttatgaaaggacatactgcactacgggtatattgacagaaggaaaatgctttgttcctgacaaggctgtcgtcagtgcattgaagagaggcatgtacgccatagcaagcatagagacaatttgcttttttattcatcagaaagggaatacatataagatagtgactgccatcacatcggcaatgggctccaaatgtaataatacagatactaaagttcaaggatattatatctgtattattggtggaaactctgcccctgtatatgcccctgctggtgaagactttagggcaatggaggttttttccgggattattacatcaccgcatggagaagaccatgatctccctggcgaagaaattgcaacataccagatttcagggcagatagaggcaaaaatccctcatacagtgagctccaagaacttaaaattgactgcttttgcaggtattccatcatactcatcaaccagtatattggctgcttcagaagatggtcgtttcatatttagtcctggtctatttcctaacctaaatcagtcagtctgtgacaacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttccccaatgtgtcttgtgtccaagcaaaataggtttagagcagctgagcagcagatcagctttgtttgccaaagggttgatatggatattatagtgtactgtaatggtcagaaaaagacaatcctaacaaaaacattagttataggccaatgcatttatactattacaagtctcttttcactgttaccaggggttgcccattctattgctattgagttgtgtgttccaggatttcatggctgggccacagctgcacttttgatcacattctgctttggctgggtattgattcctgcatgtacattagctattcttttagttctcaagttttttgcaaatatcctccacacaagcaatcaagagaaccgattcaaagccattctacggaaaataaaggaggagtttgaaaaaacaaaaggttccatggtttgtgagatctgtaagtacgagtgtgaaacattaaaggaattgaaggcacataatctatcatgtgttcaaggggaatgcccatattgctttacccactgtgaaccgacagaaactgcaattcaggcacattacaaagtttgtcaagctacccaccgattcagagaagatttaaaaaagactgtaactcctcaaaatattgggcctggctgttaccgaacattaaatctttttaggtataaaagcaggtgttatattctgacaatgtggactcttcttctcattattgaatccatcctctgggcagcaagtgcagcagaaatcccccttgtccctctctggacagataatgctcatggtgttgggagtgttcctatgcatacagaccttgaattagacttttctttaccatctagttctaggtacacatataaaagacatctcacaaacccagttaatgaccaacagagtgtctcattgcacatagaaattgaaagtcaaggcattggtgctgatgtccaccatcttggacattggtatgatgcaagattgaatttaaaaacctcatttcattgttatggtgcctgcacaaaatatcaatatccatggcacactgcaaaatgccattttgagaaagattatgagtatgaaaatagctgggcgtgcaaccccccagattgcccaggggttggtacaggttgtactgcttgtgggttatatctcgatcaattgaagccggtaggaacagcctttaaaattataagtgtgagatacagtagaaaagtgtgcgtgcagtttggtgaagaatacctttgtaaaacaattgatatgaatgattgctttgtgactaggcatgccaaaatatgtataattgggactgtatctaagttttctcaaggtgacactctactatttctggggcccatggaaggaggtggtataatctttaaacactggtgcacatctacctgtcactttggagaccctggtgacgtcatgggtccaaaggataaaccatttatttgccctgaattcccagggcaattcaggaaaaaatgtaactttgccacatctccagtttgtgaatatgatgggaacattatctcaggctataagaaagttcttgcaacaattgattctttccaatcatttaacacaagcaatatacacttcactgatgagagaattgaatggagagaccctgatggtatgcttcgggaccatattaatatcgttatttctaaagatattgattttgaaaatttggctgagaatccttgtaaagtagggctccaggcagcaaacatagaaggtgcctggggttcaggtgttgggtttacactcacatgccaggtgtctctcacagaatgcccaacatttctcacgtcaataaaggcttgtgacatggcaatttgttatggtgcagaaagtgtaacactctcacgaggacaaaatactgtcaaaattaccgggaaaggtggccatagtggttcctcatttaagtgctgtcatgggaaagaatgttcattaactggcctccaagccagtgcaccgcatctggataaggtaaatggtatatctgagttagaaaatgagaaagtttatgatgatggtgcaccagaatgtggcattacttgttggtttaagaaatcaggtgagtgggttatgggtataatcaatggaaactgggttgtcctaattgctttgtgtgtcctgttgcttttttctcttatcctgttgagcattttgtgtcctgttagaaagcataaaaaatcataa

SEQ ID NO: 3476 - RNA, 3402 nt, synthetic construct
  misc_feature 1..3402: note = derived and/or modified CDS sequence (wt) from SEOV(WuhanRf02)__JQ665888.1__GP
  source 1..3402: mol_type = other RNA
atgtggagtttgctattactggccgctttagttggccaaggctttgcattaaaaaatgtatttgacatgagaatccagtgtccccactcagtcaactttggggaaacaagtgtgtcaggctatacagaattgcccccactctcattacaggaggctgaacagctagtgccagagagctcatgtaacatggacaaccaccaatcactctcaacaataaataaattaaccaaggtcatatggcggaaaaaagcaaatcaggaatcagcgaaccagaattcctttgaagttatagagagtgaagtcagctttaaagggttgtgtatgttaaagcatagaatggttgaagaatcatatagaaacaggagatcagtgatctgttatgatctagcctgtaatagcacattctgtaagccaactgtttacatgattgttcctatacatgcctgcaacatgatgaaaagctgtttgattggccttggtccctacagaatccaggttgtctatgaaaggacatactgcactacaggtatattgacagaaggaaaatgctttgtccccgacaaggctgttgttagtgcattgaagagaggcatgtatgccgtagcaagcatagagacaatctgcttttttattcatcagaaaggaaatacatataagatagtgactgccattacatcagcaatgggctccaaatgtaataatacagatactaaagttcaaggatattacatctgtattattggtggaaactccgcccctgtatatgcccctgctggtgaagactttagggcaatggaggttttttctgggattattacatcaccacatggagaagaccatgacctccctggcgaagaaattgcaacataccagatttcagggcagatagaggcaaaaatccctcatactgtgagctctaaaaacttaaaattaactgcttttgcaggtattccatcatactcatcaactagtatattggctgcttcagaagatggtcgtttcatattcagccctggtttgtttcccaacctaaatcagtcagtctgtgacaacaatgcactccctttaatctggaggggcctaattgatttaacaggatactatgaggcagtccacccttgcaatgtattctgtgtcttatcaggaccaggtgcttcatgtgaagccttttcagaaggaggtattttcaatattacttctccaatgtgtctggtgtccaagcaaaataggtttcgagcagctgagcagcggattagctttgtctgtcaaagggttgatatggatattatagtatactgtaatggtcaaaaaaagacaatcctaacaaaaacattagttataggccaatgtatttatactattacaagtctcttttcactgttaccaggggtggcccattctattgctattgagttgtgtgttccaggtttccatggctgggccacagctgcacttttaactacattctgctttggctgggtattaattcctgcatgtacattagctattcttttagttcttaagttttttgcaaacatccttcatacaagcaatcaagagaaccgattcaaagccattctacgtaaaataaaggaggagtttgaaaaaacaaagggttccgtggtttgtgagatctgtaaatatgagtgtgaaacattaaaggaattaaaggcacataatctatcatgtgttcaaggggagtgcccatattgctttacccactgtgaaccgacagaaactgcaattcaggcacattacaaagtttgtcaagccacccatcgattcagagaagatttaaaaaagactgtaactcctcaaaatatcgggccgggctgttaccgaacattaaatctttttaggtataatagtaggcctgatggtctgacaatgtggactcttcttctcattattgaatccatcctctgggcggcaagtgcagcagaaatcccccttgtccctctctgggcagataatgctcatggcgtcgggagtgttcctatgcatacagatcttgaattagacttttctttgccatccagttctaaatacacatataaaagacatctcacaaacccagttaatgaccaacagagtgtctcattgcatatagaaattgaaagtcaaggtattggtgctgatgttcatcatcttggacattggtatgatgcaagattgaatctaaaaacctcatttcattgttatggtgcctgcacaaaatatcaatatccatggcacactgcaaaatgtcattttgagaaagattatgagtatgaaaatagctgggcatgcaaccccccagattgcccaggggttggtacaggttgtactgcttgtggattatatttagatcaattgaagccagtaggaacagccttcaaaattataagtgtgagatacagtagaaaagtgtgtgtgcagtttggtgaagaatacctttgtaaaacaattgatatgaatgattgctttgtgactaggcatgctaaaatatgtataattgggactgtacctaagttttctcaaggtgacactctactatttcttgggcccatggaaggaggtggtataatctttaaacactggtgtacatcgacttgtcactttggagaccctggtgatgtcatgggtccaaaagataaaccatttattcgccctgaattcccagggcaatttaggaaaaaatgtaactttgccacaactccggtttgtggatatgatgggaatattatctcaggttataagaaagttcttgcaacaattgattctttccaatcatttaacacaagcaatatacacttcactgatgagagaattgaatggagagaccctgatggtatgcttcgggatcatattaacatcgttatttctaaagatattgattttgaaaatttggctgagaatccttgtaaagtagggctccaggcagcaaacatagaaggtgcttggggttcaggtgtcgggtttacacttacatgccaggtgtctctcacagaatgcccaacatttctcacgtcaataaaggcctgtgatatggcaatttgttatggtgcagaaagtgtgacactctcacgaggacaaaacactgtcaaaattaccgggaaaggtggccatagtggttcttcatttaaatgctgtcatggaaaagaatgttcatcaactggcctccaagccagtgcaccgcatctggataaggtaaatggtatatctgagttagaaaacgagaaagtttatgatgatggtgcaccagaatgtggcattacttgttggtttaagaaatcaggtgagtgggttatgggtataatcaatggaaactgggttgtcctaattgctttgtgtgtcctgttgcttttttctcttatcctgttaagcattttgtgtcctgttagaaagcataaaaaatcatga

SEQ ID NO: 3477 - RNA, 3402 nt, synthetic construct
  misc_feature 1..3402: note = derived and/or modified CDS sequence (wt) from SEOV(WuhanRf07)__JQ665889.1__GP
  source 1..3402: mol_type = other RNA
atgtggagtttgctattactggccgctttagttggccaaggctttgcattaaaaaatgtatttgacatgagaatccagtgtccccactcagtcaactttggggaaacaagtgtgtcaggctatacagaattgcccccactctcattacaggaggctgaacagctagtgccagagagctcatgtaacatggacaaccaccaatcactctcaacaataaataaattaaccaaggtcatatggcggaaaaaagcaaatcaggaatcagcgaaccagaattcctttgaagttatagagagtgaagtcagctttaaagggttgtgtatgttaaagcatagaatggttgaagaatcatatagaaacaggagatcagtgatctgttatgatctagcctgtaatagcacattctgtaagccaactgtttacatgattgttcctatacatgcctgcaacatgatgaaaagctgtttgattggccttggtccctacagaatccaggttgtctatgaaaggacatactgcactacaggtatattgacagaaggaaaatgctttgtccccgacaaggctgttgttagtgcattgaagagaggcatgtatgccgtagcaagcatagagacaatctgcttttttattcatcagaaaggaaatacatataagatagtgactgccattacatcagcaatgggctccaaatgtaataatacagatactaaagttcaaggatattacatctgtattattggtggaaactccgcccctgtatatgcccctgctggtgaagactttagggcaatggaggttttttctgggattattacatcaccacatggagaagaccatgacctccctggcgaagaaattgcaacataccagatttcagggcagatagaggcaaaaatccctcatactgtgagctctaaaaacttaaaattaactgcttttgcaggtattccatcatactcatcaactagtatattggctgcttcagaagatggtcgtttcatattcagccctggtttgtttcccaacctaaatcagtcagtctgtgacaacaatgcactccctttaatctggaggggcctaattgatttaacaggatactatgaggcagtccacccttgcaatgtattctgtgtcttatcaggaccaggtgcttcatgtgaagccttttcagaaggaggtattttcaatattacttctccaatgtgtctggtgtccaagcaaaataggtttcgagcagctgagcagcagattagctttgtctgtcaaagggttgatatggatattatagtatactgtaatggtcaaaaaaagacaatcctaacaaaaacattagttataggccaatgtatttatactattacaagtctcttttcactgttaccaggggtggcccattctattgctattgagttgtgtgttccaggtttccatggctgggccacagctgcacttttaactacattctgctttggctgggtattaattcctgcatgtacattagctattcttttagttcttaagttttttgcaaacatccttcatacaagcaatcaagagaaccgattcaaagccattctacgtaaaataaaggaggagtttgaaaaaacaaagggttccatggtttgtgagatctgtaaatatgagtgtgaaacattaaaggaattaaaggcacataatctatcatgtgttcaaggggagtgcccatattgctttacccactgtgaaccgacagaaactgcaattcaggcacattacaaagtttgtcaagccacccatcgattcagagaagatttaaaaaagactgtaactcctcaaaatatcgggccgggctgttaccgaacattaaatctttttaggtataaaagtaggccttatattctgacaatgtggactattcttctcattattgaatccatcctctgggcggcaagtgcagcagaaatcccccttgtccctctctggacagataatgctcatggcgtcgggagtgttcctatgcatacagatcttgaattagacttttctttgccatccagttctaaatacacatataaaagacatctcacaaacccagttaatgaccaacagagtgtctcattgcatatagaaattgaaagtcaaggtattggtgctgatgttcatcatcttggacattggtatgatgcaagattgaatctaaaaacctcatttcattgttatggtgcctgcacaaaatatcaatatccatggcacactgcaaaatgtcattttgagaaagattatgagtatgaaaatagctgggcatgcaaccccccagattgcccaggggttggtacaggttgtactgcttgtggattatatttagatcaattgaagccagtaggaacagccttcaaaattataagtgtgagatacagtagaaaagtgtgtgtgcagtttggtgaagaatacctttgtaaaacaattgatatgaatgattgctttgtgactaggcatgctaaaatatgtataattgggactgtatctaagttttctcaaggtgacactctactatttcttgggcccatggaaggaggtggtataatctttaaacactggtgtacatcgacttgtcactttggagaccctggtgatgtcatgggtccaaaagataaaccatttatttgccctgaattcccagggcaatttaggaaaaaatgtaactttgccacaactccggtttgtgaatatgatgggaatattatctcaggttataagaaagttcttgcaacaattgattctttccaatcatttaacacaagcaatatacacttcactgatgagagaattgaatggagagaccctgatggtatgcttcgggatcatattaacatcgttatttctaaagatattgattttgaaaatttggctgagaatccttgtaaagtagggctccaggcagcaaacatagaaggtgcttggggttcaggtgtcgggtttacacttacatgccaggtgtctctcacagaatgcccaacatttctcacgtcaataaaggcctgtgatatggcaatttgttatggtgcagaaagtgtgacactctcacgaggacaaaacactgtcaaaattaccgggaaaggtggccatagtggttcttcatttaaatgctgtcatggaaaagaatgttcatcaactggcctccaagccagtgcaccgcatctggataaggtaaatggtatatctgagttagaaaacgagaaagtttatgatgatggtgcaccagaatgtggcattacttgttggtttaagaaatcaggtgagtgggttatgggtataatcaatggaaactgggttgtcctaattgctttgtgtgtcctgttgcttttttctcttatcctgttaagcattttgtgtcctgttagaaagcataaaaaatcatga

SEQ ID NO: 3478 - RNA, 3402 nt, synthetic construct
  misc_feature 1..3402: note = derived and/or modified CDS sequence (wt) from SEOV(WuhanRf18)__JQ665893.1__GP
  source 1..3402: mol_type = other RNA
atgtggagtttgctattactggccgctttagttggccaaggctttgcattaaaaaatgtatttgacatgagaatccagtgtccccactcagtcaactttggggaaacaagtgtgtcaggctatacagaattgcccccactctcattacaggaggctgaacagctagtgccagagagctcatgtaacatggacaaccaccaatcactctcaacaataaataaattaaccaaggtcatatggcggaaaaaagcaaatcaggaatcagcgaaccagaattcctttgaagttatagagagtgaagtcagctttaaagggttgtgtatgttaaagcatagaatggttgaagaatcatatagaaacaggagatcagtgatctgttatgatctagcctgtaatagcacattctgtaagccaactgtttacatgattgttcctatacatgcctgcaacatgatgaaaagctgtttgattggccttggtccctacagaatccaggttgtctatgaaaggacatactgcactacaggtatattgacagaaggaaaatgctttgtccccgacaaggctgttgttagtgcattgaagagaggcatgtatgccgtagcaagcatagagacaatctgcttttttattcatcagaaaggaaatacatataagatagtgactgccattacatcagcaatgggctccaaatgtaataatacagatactaaagttcaaggatattacatctgtattattggtggaaactccgcccctgtatatgcccctgctggtgaagactttagggcaatggaggttttttctgggattattacatcaccacatggagaagaccatgacctccctggcgaagaaattgcaacataccagatttcagggcagatagaggcaaaaatccctcatactgtgagctctaaaaacttaaaattaactgcttttgcaggtattccatcatactcatcaactagtatattggctgcttcagaagatggtcgtttcatattcagccctggtttgtttcccaacctaaatcagtcagtctgtgacaacaatgcactccctttaatctggaggggcctaattgatttaacaggatactatgaggcagtccacccttgcaatgtattctgtgtcttatcaggaccaggtgcttcatgtgaagccttttcagaaggaggtattttcaatattacttctccaatgtgtctggtgtccaagcaaaataggtttcgagcagctgagcagcggattagctttgtctgtcaaagggttgatatggatattatagtatactgtaatggtcaaaaaaagacaatcctaacaaaaacattagttataggccaatgtatttatactattacaagtctcttttcactgttaccaggggtggcccattctattgctattgagttgtgtgttccaggtttccatggctgggccacagctgcacttttaactacattctgctttggctgggtattaattcctgcatgtacattagctattcttttagttcttaagttttttgcaaacatccttcatacaagcaatcaagagaaccgattcaaagccattctacgtaaaataaaggaggagtttgaaaaaacaaagggttccatggtttgtgagatctgtaaatatgagtgtgaaacattaaaggaattaaaggcacataatctatcatgtgttcaaggggagtgcccatattgctttacccactgtgaaccgacagaaactgcaattcaggcacattacaaagtttgtcaagccacccatcgattcagagaagatttaaaaaagactgtaactcctcaaaatatcgggccgggctgttaccgaacattaaatctttttaggtataaaagtagatgttatattctgacaatgtggactattcttctcattattgaatccatcctctgggcggcaagtgcagcagaaatcccccttgtccctctctggacagataatgctcatggcgtcgggagtgttcctatgcatacagatcttgaattagacttttctttgccatccagttctaaatacacatataaaagacatctcacaaacccagttaatgaccaacagagtgtctcattgcatatagaaattgaaagtcaaggtattggtgctgatgttcatcatcttggacattggtatgatgcaagattgaatctaaaaacctcatttcattgttatggtgcctgcacaaaatatcaatatccatggcacactgcaaaatgtcattttgagaaagattatgagtatgaaaatagctgggcatgcaaccccccagattgcccaggggttggtacaggttgtactgcttgtggattatatttagatcaattgaagccagtaggaacagccttcaaaattataagtgtgagatacagtagaaaagtgtgtgtgcagtttggtgaagaatacctttgtaaaacaattgatatgaatgattgctttgtgactaggcatgctaaaatatgtataattgggactgtatctaagttttctcaaggtgacactctactatttcttgggcccatggaaggaggtggtataatctttaaacactggtgtacatcgacttgtcactttggagaccctggtgatgtcatgggtccaaaagataaaccatttatttgccctgaattcccagggcaatttaggaaaaaatgtaactttgccacaactccggtttgtgaatatgatgggaatattatctcaggttataagaaagttcttgcaacaattgattctttccaatcatttaacacaagcaatatacacttcactgatgagagaattgaatggagagaccctgatggtatgcttcgggatcatattaacatcgttatttctaaagatattgattttgaaaatttggctgagaatccttgtaaagtagggctccaggcagcaaacatagaaggtgcttggggttcaggtgtcgggtttacacttacatgccaggtgtctctcacagaatgcccaacatttctcacgtcaataaaggcctgtgatatggcaatttgttatggtgcagaaagtgtgacactctcacgaggacaaaacactgtcaaaattaccgggaaaggtggccatagtggttcttcatttaaatgctgtcatggaaaagaatgttcatcaactggcctccaagccagtgcaccgcatctggataaggtaaatggtatatctgagttagaaaacgagaaagtttatgatgatggtgcaccagaatgtggcattacttgttggtttaagaaatcaggtgagtgggttatgggtataatcaatggaaactgggttgtcctaattgctttgtgtgtcctgttgcttttttctcttatcctgttaagcattttgtgtcctgttagaaagcataaaaaatcatga

SEQ ID NO: 3479 - RNA, 3402 nt, synthetic construct
  misc_feature 1..3402: note = derived and/or modified CDS sequence (wt) from SEOV(WuhanRn10)__JQ665896.1__GP
  source 1..3402: mol_type = other RNA
atgtggagtttgctattactggccgctttagttggccaaggctttgcattaaaaaatgtatttgacatgagaatccagtgtccccactcagtcaactttggggaaacaagtgtgtcaggctatacagaattgcccccactctcattacaggaggctgaacagctagtgccagagagctcatgtaacatggacaaccaccaatcactctcaacaataaataaattaaccaaggtcatatggcggaaaaaagcaaatcaggaatcagcgaaccagaattcctttgaagttatagagagtgaagtcagctttaaagggttgtgtatgttaaagcatagaatggttgaagaatcatatagaaacaggagatcagtgatctgttatgatctagcctgtaatagcacattctgtaagccaactgtttacatgattgttcctatacatgcctgcaacatgatgaaaagctgtttgattggccttggtccctacagaatccaggttgtctatgaaaggacatactgcactacaggtatattgacagaaggaaaatgctttgtccccgacaaggctgttgttagtgcattgaagagaggcatgtatgccgtagcaagcatagagacaatctgcttttttattcatcagaaaggaaatacatataagatagtgactgccattacatcagcaatgggctccaaatgtaataatacagatactaaagttcaaggatattacatctgtattattggtggaaactccgcccctgtatatgcccctgctggtgaagactttagggcaatggaggttttttctgggattattacatcaccacatggagaagaccatgacctccctggcgaagaaattgcaacataccagatttcagggcagatagaggcaaaaatccctcatactgtgagctctaaaaacttaaaattaactgcttttgcaggtattccatcatactcatcaactagtatattggctgcttcagaagatggtcgtttcatattcagccctggtttgtttcccaacctaaatcagtcagtctgtgacaacaatgcactccctttaatctggaggggcctaattgatttaacaggatactatgaggcagtccacccttgcaatgtattctgtgtcttatcaggaccaggtgcttcatgtgaagccttttcagaaggaggtattttcaatattacttctccaatgtgtctggtgtccaagcaaaataggtttcgagcagctgagcagcagattagctttgtctgtcaaagggttgatatggatattatagtatactgtaatggtcaaaaaaagacaatcctaacaaaaacattagttataggccaatgtatttatactattacaagtctcttttcactgttaccaggggtggcccattctattgctattgagttgtgtgttccaggtttccatggctgggccacagctgcacttttaactacattctgctttggctgggtattaattcctgcatgtacattagctattcttttagttcttaagttttttgcaaacatccttcatacaagcaatcaagagaaccgattcaaagccattctacgtaaaataaaggaggagtttgaaaaaaacaagggttccgtggtttgtgagatctgtaaatatgagtgtgaaacattaaaggaattaaaggcacataatctatcatgtgttcaaggggagtgcccatattgctttacccactgtgaaccgacagaaactgcaattcaggcacattacaaagtttgtcaagccacccatcgattcagagaagatttaaaaaagactgtaactcctcaaaatatcgggccgggctgttaccgaacattaaatctttttaggtataaaagtagatgttatattctgacaatgtggactattcttctcattattgaatccatcctctgggcggcaagtgcagcagaaatcccccttgtccctctctggacagataatgctcatggcgtcgggagtgttcctatgcatacagatcttgaattagacttttctttgccatccagttctaaatacacatataaaagacatctcacaaacccagttaatgaccaacagagtgtctcattgcatatagaaattgaaagtcaaggtattggtgctgatgttcatcatcttggacattggtatgatgcaagattgaatctaaaaacctcatttcattgttatggtgcctgcacaaaatatcaatatccatggcacactgcaaaatgtcattttgagaaagattatgagtatgaaaatagctgggcatgcaaccccccagattgcccaggggttggtacaggttgtactgcttgtggattatatttagatcaattgaagccagtaggaacagccttcaaaattataagtgtgagatacagtagaaaagtgtgtgtgcagtttggtgaagaatacctttgtaaaacaattgatatgaatgattgctttgtgactaggcatgctaaaatatgtataattgggactgtatctaagttttctcaaggtgacactctactatttcttgggcccatggaaggaggtggtataatctttaaacactggtgtacatcgacttgtcactttggagaccctggtgatgtcatgggtccaaaagataaaccatttatttgccctgaattcccagggcaatttaggaaaaaatgtaactttgccacaactccggtttgtgaatatgatgggaatattatctcaggttataagaaagttcttgcaacaattgattctttccaatcatttaacacaagcaatatacacttcactgatgagagaattgaatggagagaccctgatggtatgcttcgggatcatattaacatcgttatttctaaagatattgattttgaaaatttggctgagaatccttgtaaagtagggctccaggcagcaaacatagaaggtgcttggggttcaggtgtcgggtttacacttacatgccaggtgtctctcacagaatgcccaacatttctcacgtcaataaaggcctgtgatatggcaatttgttatggtgcagaaagtgtgacactctcacgaggacaaaacactgtcaaaattaccgggaaaggtggccatagtggttcttcatttaaatgctgtcatggaaaagaatgttcatcaactggcctccaagccagtgcaccgcatctggataaggtaaatggtatatctgagttagaaaacgagaaagtttatgatgatggtgcaccagaatgtggcattacttgttggtttaagaaatcaggtgagtgggttatgggtataatcaatggaaactgggttgtcctaattgctttgtgtgtcctgttgcttttttctcttatcctgttaagcattttgtgtcctgttagaaagcataaaaaatcatga

SEQ ID NO: 3480 - RNA, 3402 nt, synthetic construct
  misc_feature 1..3402: note = derived and/or modified CDS sequence (wt) from SEOV(WuhanRn25)__JQ665897.1__GP
  source 1..3402: mol_type = other RNA
atgtggagtttgctattactggccgctttagttggccaaggctttgcattaaaaaatgtatttgacatgagaatccagtgtccccactcagtcaactttggggaaacaagtgtgtcaggctatacagaattgcccccactctcattacaggaggctgaacagctagtgccagagagctcatgtaacatggacaaccaccaatcactctcaacaataaataaattaaccaaggtcatatggcggaaaaaagcaaatcaggaatcagcgaaccagaattcctttgaagttatagagagtgaagtcagctttaaagggttgtgtatgttaaagcatagaatggttgaagaatcatatagaaacaggagatcagtgatctgttatgatctagcctgtaatagcacattctgtaagccaactgtttacatgattgttcctatacatgcctgcaacatgatgaaaagctgtttgattggccttggtccctacagaatccaggttgtctatgaaaggacatactgcactacaggtatattgacagaaggaaaatgctttgtccccgacaaggctgttgttagtgcattgaagagaggcatgtatgccgtagcaagcatagagacaatctgcttttttattcatcagaaaggaaatacatataagatagtgactgccattacatcagcaatgggctccaaatgtaataatacagatactaaagttcaaggatattacatctgtattattggtggaaactccgcccctgtatatgcccctgctggtgaagactttagggcaatggaggttttttctgggattattacatcaccacatggagaagaccatgacctccctggcgaagaaattgcaacataccagatttcagggcagatagaggcaaaaatccctcatactgtgagctctaaaaacttaaaattaactgcttttgcaggtattccatcatactcatcaactagtatattggctgcttcagaagatggtcgtttcatattcagccctggtttgtttcccaacctaaatcagtcagtctgtgacaacaatgcactccctttaatctggaggggcctaattgatttaacaggatactatgaggcagtccacccttgcaatgtattctgtgtcttatcaggaccaggtgcttcatgtgaagccttttcagaaggaggtattttcaatattacttctccaatgtgtctggtgtccaagcaaaataggtttcgagcagctgagcagcagattagctttgtctgtcaaagggttgatatggatattatagtatactgtaatggtcaaaaaaagacaatcctaacaaaaacattagttataggccaatgtatttatactattacaagtctcttttcactgttaccaggggtggcccattctattgctattgagttgtgtgttccaggtttccatggctgggccacagctgcacttttaactacattctgctttggctgggtattaattcctgcatgtacattagctattcttttagttcttaagttttttgcaaacatccttcatacaagcaatcaagagaaccgattcaaagccattctacgtaaaataaaggaggagtttgaaaaaaacaagggttccatggtttgtgagatctgtaaatatgagtgtgaaacattaaaggaattaaaggcacataatctatcatgtgttcaaggggagtgcccatattgctttacccactgtgaaccgacagaaactgcaattcaggcacattacaaagtttgtcaagccacccatcgattcagagaagatttaaaaaagactgtaactcctcaaaatatcgggccgggctgttaccgaacattaaatctttttaggtataaaagtagatgttatattctgacaatgtggactattcttctcattattgaatccatcctctgggcggcaagtgcagcagaaatcccccttgtccctctctggacagataatgctcatggcgtcgggagtgttcctatgcatacagatcttgaattagacttttctttgccatccagttctaaatacacatataaaagacatctcacaaacccagttaatgaccaacagagtgtctcattgcatatagaaattgaaagtcaaggtattggtgctgatgttcatcatcttggacattggtatgatgcaagattgaatctaaaaacctcatttcattgttatggtgcctgcacaaaatatcaatatccatggcacactgcaaaatgtcattttgagaaagattatgagtatgaaaatagctgggcatgcaaccccccagattgcccaggggttggtacaggttgtactgcttgtggattatatttagatcaattgaagccagtaggaacagccttcaaaattataagtgtgagatacagtagaaaagtgtgtgtgcagtttggtgaagaatacctttgtaaaacaattgatatgaatgattgctttgtgactaggcatgctaaaatatgtataattgggactgtatctaagttttctcaaggtgacactctactatttcttgggcccatggaaggaggtggtataatctttaaacactggtgtacatcgacttgtcactttggagaccctggtgatgtcatgggtccaaaagataaaccatttatttgccctgaattcccagggcaatttaggaaaaaatgtaactttgccacaactccggtttgtgaatatgatgggaatattatctcaggttataagaaagttcttgcaacaattgattctttccaatcatttaacacaagcaatatacacttcactgatgagagaattgaatggagagaccctgatggtatgcttcgggatcatattaacatcgttatttctaaagatattgattttgaaaatttggctgagaatccttgtaaagtagggctccaggcagcaaacatagaaggtgcttggggttcaggtgtcgggtttacacttacatgccaggtgtctctcacagaatgcccaacatttctcacgtcaataaaggcctgtgatatggcaatttgttatggtgcagaaagtgtgacactctcacgaggacaaaacactgtcaaaattaccgggaaaggtggccatagtggttcttcatttaaatgctgtcatggaaaagaatgttcatcaactggcctccaagccagtgcaccgcatctggataaggtaaatggtatatctgagttagaaaacgagaaagtttatgatgatggtgcaccagaatgtggcattacttgttggtttaagaaatcaggtgagtgggttatgggtataatcaatggaaactgggttgtcctaattgctttgtgtgtcctgttgcttttttctcttatcctgttaagcattttgtgtcctgttagaaagcataaaaaatcatga

SEQ ID NO: 3481 - RNA, 3402 nt, synthetic construct
  misc_feature 1..3402: note = derived and/or modified CDS sequence (wt) from SEOV(XiaotangshanRn7)__GU592929.1__GP
  source 1..3402: mol_type = other RNA
atgtggagtttgctatttttggccgctttagttggccaaggctttgcattaaaaaatgtgtttgacatgagaattcagtgtccccactcagtcaactttggagaaacaagtgtgtcaggctatacagaattgcccccactctcattacaggaggcagaacagctggtgccagagagctcatgcaacatggacaaccaccaatcactctcaacaataaataaactaactaaggtaatatggcggagaaaagcaaatcaagaatcagcaaaccagaattcatttgaagttgtggagagtgaagtcagctttaaagggttgtgtatgttaaagcatagaatggttgaagaatcatatagaaacaggagatcagtaatctgttatgatctagcctgtaatagtacattctgtaagccaactgtttacatgattgttcctatacatgcttgtaacatgatgaaaagctgtttgattggcctcggtccctacagaattcaggttgtctatgaaaggacatactgcactacgggtatattgacagaaggaaagtgctttgtcccagacaaggctgttgtcagtgcattgaagagaggcatgtatgccatagcaagcatagagacaatctgcttctttattcatcagaaagggaatacatataagatagtgactgccattacatcagcaatgggctccaaatgtaataatacagatactaaagttcagggatattatatctgtattattggtggaaactctgcccctgtatatgcccctgctggtgaagactttagggcgatggaggttttttctgggattattacatcgccgcatggagaagaccatgacctccctggcgaagaaattgcaacataccagatttcagggcagatagaggcaaaaatccctcatacagtgagctctaaaaacttaaaattgactgcttttgcaggtattccatcatactcatcaactagtatattagctgcttcagaagatggtcgtttcatatttagtcctggtttgtttcctaacctaaatcagtcagtctgtgataacaatgcactccctttaatctggaggggcctaattgatttaacgggatactatgaggcagtccacccttgcaatgtattctgtgtcttatcaggaccaggtgcttcatgtgaagccttttcagaaggaggtattttcaatattacttctccaatgtgtctggtgtccaagcaaaataggtttagagccgctgagcagcagatcagctttgtttgccaaagggttgatatggatatcatagtgtactgtaatggtcaaaaaaagacaatcctaacaaaaacattagttataggccaatgtatttatactattacaagtctcttttcactgctgccaggggttgcccattctattgctattgagttgtgtgttccagggtttcatggctgggccacagctgcacttttgatcacattctgctttggctgggtattgattcctgcatgtacattagctatccttctagttctcaagttttttgcaaatatccttcatacaagcaatcaagagaatcgattcaaagccattctacggaaaataaaggaggagtttgaaaaaacaaagggttccatggtttgtgaaatctgtaagtatgagtgtgaaacattaaaggaattgaaggcacataatctatcatgtgttcaaggggagtgcccatattgctttacccactgtgaaccgacagaaactgcaattcaggcacattacaaagtttgtcaagccacccaccgatttagagaagatttaaaaaagactgtaactcctcaaaatattgggccaggctgttaccgaacattgaaccttttcaggtataaaagtaggtgttatattctgacaatgtggactcttcttctcattattgaatccatcctctgggcagcaagtgcagcagaaatcccccttgtcccactctggacagataatgctcatggcgttgggagtgttcctatgcatacagatcttgaattagacttttctttgccatctagttctaagtatacatataaaagacatcttacaaacccagttaatgaccaacagagtgtctcattgcatatagaaattgaaagtcaaggcattggtgctgatgttcatcatcttggacattggtatgatgcaagattgaatctaaaaacctcatttcattgctatggtgcctgcacaaaataccaatatccatggcatactgcaaaatgccattttgagaaagattatgagtatgaaaatagttgggcatgcaaccccccagattgcccaggggttggtacaggttgtactgcttgtggattatatctagatcagttgaagccggtaggaacagccttcaaaattataagtgtacgatacagtagaaaagtgtgcgtgcagtttggtgaagaatacctttgcaaaacaattgatatgaacgattgctttgtgactagacatgccaaaatatgtataattgggactgtatctaagttctctcaaggtgacactctactatttcttgggcccatggaaggaggtggtataatctttaaacactggtgtacatctacctgtcactttggagaccctggtgatgttatgggtccaaaagataaaccatttatttgccctgaattcccagggcaattcaggaagaaatgtaattttgccacaactccagtttgtgaatatgatgggaatattatttcaggctataagaaagttcttgcaacaattgattctttccaatcatttaacacaagcaatatacatttcactgatgagagaattgaatggagagaccctgatggtatgcttcgggatcatatcaatattgttatttctaaagatattgattttgaaaatttggccgaaaacccttgtaaagtagggctccaggcagccaacatagaaggtgcttggggttcaggtgttgggtttacactcacatgccaggtgtctctcacagaatgcccaacatttctcacgtcaataaaggcttgtgacatggcaatctgttatggtgcagaaagtgtgacactctcacgaggacaaaatactgtcaaaattaccgggaaaggtggccatagtggttcttcatttaaatgctgtcatgggaaagaatgttcatcaactgggcttcaagccagtgcaccacatctagataaggtaaatggtatctctgagttagaaaacgagaaagtttatgatgatggtgcacctgaatgtggtgttacttgctggtttaaaaaatcaggtgaatgggttatgggtataatcaatgggaactgggttgtcctaattgttttgtgtgtcctgcttctcttttctcttatcctgttgagcatcttgtgtcctgtcagaaagcataaaaaatcataa

SEQ ID NO: 3482 - RNA, 3402 nt, synthetic construct
  misc_feature 1..3402: note = derived and/or modified CDS sequence (wt) from SEOV(YongjiaRf45)__GU592926.1__GP
  source 1..3402: mol_type = other RNA
atgtggggtttactattgctagccgctatggttggccaaggttcagcattgaagaatgtatttgacatgaaaattcaatgccctcactcagttaacttcggggaaacaagtgtgtcaggatatacagaattacccccactcccattacaggaggcagaacagcttgtgccagaaagttcatgtaacatggataatcatcaatcactctcaaccatcaataaactaaccaaggtaatctggagaaaaaaagcaaatcaagaatcggcaagtcaaaactcatttgaggttgtggagagtgaagtgagttttaaaggactatgcatgttaaagcatagaatggttgaggaatcatacaggaacaggaggtcagtgatctgttatgacctggcatgcaacacaacattctgtaaacctactgtctatatgattgtccctattcatgcctgtaacatgatgaaaagctgtttgattggcctcggtccttacagaattcaagtgatctatgagagaacctactgtagcacagggatactgacagaagggaaatgctttgttcatgataagactgttgtgagtgctctgaagagaggaatgtatgcaatagcaagcatagagacagtttgcttttttgtccaccaaaaaggaaatacgtacaaaatagtgacagcaatcacatcagcaatgggttcaaaatgcaacaacacagattccaaagttcaaggctactacatctgtatcattggtgggaattcagcccctgtttatgctcctgctggtgaagatttcagggcaatggaagtcttttcagggattatcacatcgccacatggggaagatcatgatcttcctggtgaggaggtagcaacataccaaatctcaggccagatagaggccaagatcccccatactgtgagttctaagaatctaaagcttactgcctttgctggcattccatcctactcatcaacaagtctcttagcggcatcagaggatggtaggtttatattcagtcctgggttgttcccaaatctcaatcaatctgtttgtgacaataatgcacttcccttaatttggaggggcctgatagacctgacaggatactatgaggcagttcacccttgcaatgttttctgtgttttatcaggaccaggtgcatcatgtgaagccttctcagaggggggtatcttcaatataacttctccgatgtgtctggtatcaaaacaaaacagatttagggcagcagaacagcaaattagcttcatctgtcagagagtagatatggatatcatagtgtattgtaatgggcaaaaaaagacaatcttaactaaaacattagttattggccagtgtatatatactataacaagtcttttttcattactacctggagttgcacactccattgctattgagctgtgcgttccaggttttcatggctgggctactgctgcactcctgattactttctgttttggttgggttttaattcctgcctgcacattggctgtcttactgtttttaaagttcttcgcaaatattttacacacaagcaaccaagagaataggtttaaagctattttgcggaaaataaaagaagaatttgaaaaaacgaagggttcaatggtatgtgaaatttgcaaatatgaatgtgaaacactgaaggagttaaaagctcacaatctgtcctgtgttcaaggagagtgcccgtactgttttacccattgtgaaccaactgaaaccgcaattcaggcccattacaaagtctgtcaggctactcatcgatttagggaagatctaaagaaaactgtgacccctcaaaatatagggccaggttgttaccgcacattaaatctttttaggtataaaagcaggtgttatatcctgacaatgtggattctcctccttgttattgagtctatattatgggcagctagtgcagcggagatcccccttgttcccttatggacagataatgctcatggagttggcagtgtcccaatgcatacagatctggaacttgatttttcattgccatctagttccaagtacacatataaaaggcatcttacaaacccagtgaacgatcaacagagtgtatctttgcatattgagattgaaagtcaaggtattggtgctgatgtccaccatctcgggcactggtatgatgcgagattgaacttgaaaacatcatttcattgttatggggcttgcacaaagtatcagtatccatggcatacagcaaagtgttattttgaaaaggattatgaatatgaaaacagttgggcatgtaatccacctgattgccctggtgtcgggataggctgcactgcttgtgggttatatttagaccaacttaaaccagtgggaacagctttcaaaattataagtgtcagatatagtaggaaagtttgtgtccagtttggtgaagaatacctttgtaaaacaattgacatgaatgattgctttgtaactagacacgccaagatctgcataattggaactgtatccaagttctcccagggtgacactctgctgtttcttggtcctatggaaggaggcggaataatcttcaaacattggtgtacatcaacttgccattttggagaccctggtgatgtcatgggcccaaaagacaagccattcatttgtcctgaattcccaggtcaattcagaaaaaaatgcaactttgccacaactccggtttgtgaatatgatggaaatgtcttttctggttatcgcaaatttcttgcaacaattgattcttttcagtcattcaatactagcaatgttcacttcacagatgagaggattgaatggagggatcctgatggtatgcttcgagaccatattaatattgttatttctaaggatattgattttgaaaacttggctgataacccgtgtaaagtaggccttcaggcagctaatatagaaggtgcttggggttcaggtgttggcttcacactcacttgccaggtgtcgcttacagaatgcccaacatttcttacatcaataaaggcttgtgacatggcaatttgttatggagcagaaagtgttacactatcacggggtcaaaacactgtcaagattacaggaaagggaggccacagtgggtcttccttcaagtgttgccatggcaaagaatgttcatcgaatggtcttcaagcaagtgctccacatttagataaagtaaatggtatttctgagttggagaatgaaaaggtctatgatgatggtgcacctgagtgtggtatcacatgctggtttaaaaaatcaggggaatgggtcatgggtatcatcaatggaaactggattgtcctgattgtcttatgtgtgttactgctgttctcacttattctgctaagcatcttatgtcctgtcaggaagcataagaagtcatga

SEQ ID NO: 3483 - RNA, 3402 nt, synthetic construct
  misc_feature 1..3402: note = derived and/or modified CDS sequence (wt) from SEOV(YongjiaRn14)__GU592927.1__GP
  source 1..3402: mol_type = other RNA
atgtggggtttactattgctagccgctatggttggccaaggttcagcattgaagaatgtatttgacatgaaaattcaatgccctcactcagttaacttcggggaaacaagtgtgtcaggatatacagaattacccccactcccattacaggaggcagaacagcttgtgccagaaagttcatgtaacatggataatcatcaatcactctcaaccatcaataaactaaccaaggtaatctggagaaaaaaagcaaatcaagaatcggcaagtcaaaactcatttgaggttgtggagagtgaagtgagttttaaaggactatgcatgttaaagcatagaatggttgaggaatcatacaggaacaggaggtcagtgatctgttatgacctggcatgcaacacaacattctgtaaacctactgtctatatgattgtccctattcatgcctgtaacatgatgaaaagctgtttgattggcctcggtccttacagaattcaagtgatctatgagagaacctactgtaccacagggatactgacagaagggaaatgctttgttcctgataaggctgttgtgagtgctctgaagagaggaatgtatgcaatagcaagcatagagacagtttgcttttttgtccaccaaaaaggaaatacgtacaaaatagtgacagcaatcacatcagcaatgggttcaaaatgcaacaacacagattccaaagttcaaggctactacatctgtatcattggtgggaattcagcccctgtttatgctcctgctggtgaagatttcagggcaatggaagtcttttcagggattatcacatcgccacatggggaagatcatgatcttcctggtgaggaggtagcaacataccaaatctcaggccagatagaggccaagatcccccatactgtgagttctaagaatctaaagcttactgcctttgctggcattccatcctactcatcaacaagtctcttagcggcatcagaggatggtaggtttatattcagtcctgggttgttcccaaatctcaatcaatctgtttgtgacaataatgcacttcccttaatttggaggggcctgatagacctgacaggatactatgaggcagttcacccttgcaatgttttctgtgttttatcaggaccaggtgcatcatgtgaagccttctcagaggggggtatcttcaatataacttctccgatgtgtctggtatcaaaacaaaacagatttagggcagcagaacagcaaattagcttcatctgtcagagagtagatatggatatcatagtgtattgtaatgggcaaaaaaagacaatcttaactaaaacattagttattggccagtgtatatatactataacaagtcttttttcattactacctggagttgcacactccattgccattgagctgtgcgttccaggttttcatggctgggctactgctgcactcctgattaccttctgttttggttgggttttaattcctgcctgcacattggctgtcttactgtttttaaagttcttcgcaaatattttacacacaagcaaccaagagaataggtttaaagctattttgcggaaaataaaagaagaatttgaaaaaacgaagggttcaatggtatgtgaaatttgcaaatatgaatgtgaaacactgaaggagttaaaagctcacaatctgtcctgtgttcaaggagagtgcccgtactgttttacccattgtgaaccaactgaaaccgcaattcaggcccattacaaagtctgtcaagctactcatcgatttagggaagatctaaagaaaactgtgacccctcaaaatatagggccaggttgttaccgcacattaaatctttttaggtataaaagcaggtgttatatcctgacaatgtggattctcctccttgttattgagtctatattatgggcagctagtgcagcggagatcccccttgttcccttatggacagataatgctcatggagttggcagtgtcccaatgcatacagatctggaacttgatttttcattgccatctagttccaagtacacatataaaaggcatcttacaaacccagtgaacgatcaacagagtgtatctttgcatattgagattgaaagtcaaggtattggtgctgatgtccaccatctcgggcactggtatgatgcgagattgaacttgaaaacatcatttcattgttatggggcttgcacaaagtatcagtatccatggcatacagcaaagtgtcattttgaaaaggattatgaatatgaaaacagttgggcatgtaatccacctgattgccctggtgtcgggacaggctgcactgcttgtgggttatatttagaccaacttaaaccagtgggaacagctttcaaaattataagtgtcagatatagtaggaaagtttgtgtccagtttggtgaagaatacctttgtaaaacaattgacatgaatgattgctttgtaactagacacgccaagatctgcataattggaactgtatccaagttctcccagggtgacactctgctgtttcttggtcctatggaaggaggcggaataatcttcaaacattggtgtacatcaacttgccattttggagaccctggtgatgtcatgggcccaaaagacaagccattcatttgtcctgaattcccaggtcaattcagaaaaaaatgcaactttgccacaactccggtttgtgaatatgatggaaatgtcatttctggttatcgcaaagttcttgcaacaattgattcttttcagtcattcaatactagcaatgttcacttcacagatgagaggattgaatggagggatcctgatggtatgcttcgagaccatattaatattgttatttctaaggatattgattttgaaaacttggctgagaacccgtgtaaagtaggccttcaggcagctaatatagaaggtgcttggggttcaggtgttggcttcacactcacttgccaggtgtcgcttacagaatgcccaacatttcttacatcaataaaggcttgtgacatggcaatttgttatggagcagaaagtgttacactatcacggggtcaaaacactgtcaagattacaggaaagggaggccacagtgggtcttccttcaagtgttgccatggcaaagaatgttcatcgaatggtcttcaagcaagtgctccacatttagataaagtaaatggtatttctgagttggagaatgaaaaggtctatgatgatggtgcacctgagtgtggtatcacatgctggtttaaaaaatcaggggaatgggtcatgggtatcatcaatggaaactggattgtcctgattgtcttatgtgtgttactgctgttctcacttattctgctaagcatcttatgtcctgtcaggaagcataagaagtcatga

SEQ ID NO: 3484 - RNA, 3402 nt, synthetic construct
  misc_feature 1..3402: note = derived and/or modified CDS sequence (wt) from SEOV(ZT10)__DQ159911.1__GP
  source 1..3402: mol_type = other RNA
atgtggagtttgctattattggccgctttagttggccaaggctttgcattaaaaaatgtgtttgacatgagaattcagtgtccccactcagtcaactttggggaaacaagtgtgtcaggctatacagaattgccaccactctcattacaggaggcagaacagctagtgccagagagctcatgcaacatggacaaccaccaatcactctcaacaataaataaattaactaaggtaatatggcggaaaaaagcaaatcaggaatcagcaaaccagaattcatttgaagttgtggagagtgaagtcagctttaaagggttgtgtatgttaaagcatagaatggttgaagaatcatatagaaacagaagatcagtaatctgttatgatctagcctgtaatagtacattttgtaagccaactgtttacatgattgttcctatacatgcatgcaacatgatgaaaagctgtttgattggccttggtccctacagaatccaggttgtctatgaaaggacatactgcactacgggtatattgacagaaggaaaatgctttgtccccgacaaggctgttgtcagtgcattgaagagaggcatgtatgccatagcaagcatagagacaatctgcttttttattcatcaaaaagggaataaatataagatagtgactgccatcacatcagcaatgggctccaaatgtaataatacagatactaaggttcagggatattatatctgtattattggtggaaactctgcccctgtatatgcccctgctggtgaagactttagggcaatggaggttttttctgggattattacgtcaccgcatggagaagaccatgacctccctggcgaagaaatcgcaacataccagatttcagggcagatagaggcaaaaatccctcatacagtaagctctaaaaacttaaaattgactgcttttgcaggtattccatcatactcatcaactagtatattggctgcttcagaagatggtcgttttatatttagtcctggtttatttcctaacctaaatcagtcagtctgtgacaacaatgcactccctttaatctggaggggcctaattgatttaacgggatactatgaggcagtccacccctgcaatgtattctgtgtcttatcaggaccaggtgcttcatgtgaagccttttcagaaggaggtattttcaatattacttctccaatgtgtctggtgtctaagcaaattaggtttagagcagctgagcagcagatcagctttatctgccaaagggtcgatatggatattatagtgtactgtaatggtcaaaaaaagacaatcctaacaaaaacattagttataggtcaatgcatttatactattacaagtctcttttcactgttgccaggggttgcccattctattgctattgagttgtgtgttccaggttttcatggctgggccacagctgcacttttgatcacattttgctttggctgggtattaattcctgcatgtacattagctattcttttagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattaaaggcacataatctatcatgtgttcaaggggagtgcccatattgctttacccactgtgaaccgacagaaactgcaattcaggcacattacaaagtgtgtcaagccacccaccgattcagagaagatttaaaaaagactgtaactcctcaaaatattggaccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttgggcattgttatgatgcaaggttgaatctaaaaacttcatttcattgctacggtgcctgcacaaaataccaatatccgtggcacaccgcaaaatgtcattttgagaaagattatgagtatgaaaatagttgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacacactactatttcttgggcccatggaaggaggtggtataatctttaaacactggtgtacatctacctgtcactttggagaccctggtgatgttatgggtccaaaagataaaccatttatttgccctgaattcccagggcaattcaggaagaaatgtaattttgccacaactccagtttgtgaatatgatgggaacattatttcaggctataagaaagttcttgcaacaattgattctttccaatcatttaacacaagcaatatacacttcactgatgagagaattgaatggagagaccctgatggtatgcttcgggatcatattaatattgttatttctaaagatattgattttgaaaatttggccgagaatccttgtaaagtagggctccaggcagcaaacatagaaggtgcttggggtttaggtgtcgggttcacactcacatgccaggtgtctctcacagaatgcccaacatttctcacgtcaataaaggcctgtgacatggcaatttgttatggtgcagaaagtgtgacactctcacgagggcaaaatactgtcaaaattaccgggaaaggtggccatagtggttcttcatttaaatgctgtcatgggaaagaatgttcatcaactggccttcaagccagtgcaccacatctggataaggtcaatggtatctctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctgctgctcttttctcttatcctgttgagcatcttgtgtcctgttagaaagcataaaaaatcataa

SEQ ID NO: 3485 - RNA, 3402 nt, synthetic construct
  misc_feature 1..3402: note = derived and/or modified CDS sequence (wt) from SEOV(ZT71)__EF117248.1__GP
  source 1..3402: mol_type = other RNA
atgtggagtttgctattattggccgctttagttggccaaggctttgcattaaaaaatgtgtttgacatgagaattcagtgtccccactcagtcaactttggggaaacaagtgtgtcaggctatacagaattgccaccactctcattacaggaggcagaacagctagtgccagagagctcatgcaacatggacaaccaccaatcactctcaacaataaataaattaactaaggtaatatggcggaaaaaagcaaatcaggaatcagcaaaccagaattcatttgaagttgtggagagtgaagtcagctttaaagggttgtgtatgttaaagcatagaatggttgaagagtcatatagaaacaggagatcagtaatctgttatgatctagcctgtaatagtacattttgtaagccaactgtttacatgattgttcctatacatgcatgcaacatgatgaaaagctgtttgattggccttggtccctatagaatccaggttgtctatgaaaggacatactgcactacaggtatattggcagaaggaaagtgctttgtccccgacaaggctgttgtcagtgcattgaagagaggcatgtatgccatagcaagcatagagacaatctgcttttttattcatcaaaaagggaataaatataagatagtgactgccatcacatcagcaatgggctccaaatgtaataatacagatactaaagttcagggatattatatctgtattattggtggaaactctgcccctgtatatgcccctgctggtgaagactttagggcaatggaggttttttctgggattattacgtcaccgcatggagaagaccatgacctccctggcgaagaaatcgcaacataccagatttcagggcagatagaggcaaaaatccctcatacagtaagctctaaaaacttaaaattgactgcttttgcaggtattccatcatactcatcaactagtatattggctgcttcagaagatggtcgttttatatttagtcctggtttatttcctaacctaaatcagtcagtctgtgataacaatgcactccctttaatctggaggggcctaattgatttaacgggatactatgaggcagtccatccctgcaatgtattctgtgtcttatcaggaccaggtgcttcatgtgaagccttttcagaaggaggtattttcaatattacttctccaatgtgtctggtgtctaagcaaaataggtttagagcagctgagcagcagatcagctttatctgccaaagggtcgatatggatattatagtgtactgtaatggtcaaaaaaagacaatcctaacaaaaacattagttataggtcaatgcatttatactattacaagtctcttttcactgttgccaggggttgcccattctattgctattgagttgtgtgttccagggtttcatggctgggccacagctgcacttttgatcacattttgctttggctgggtattaattcctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtgtgtcaagccactcaccgattcagagaagatttaaaaaagactgtaactcctcaaaatattggaccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttggacattggtatgatgcagggttgaacctaaaaacttcatttcactgctacggtgcctgcacaaaataccaatatccgtggcacaccgcaaaatgtcattttgagaaagattatgagtatgaaaatagttgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacacactactatttcttgggcccatggaaggaggtggtataatctttaaacactggtgtacatctacctgtcactttggagaccctggtgatgttatgggtccaaaagataaaccatttatttgccctgaattcccagggcaattcaggaagaaatgtaattttgccacaactccagtttgtgaatatgatgggaacattatttcaggctataagaaagttcttgcaacaattgattctttccaatcatttaacacaagcaatatacacttcactgatgagagaattgaatggagagaccctgatggtatgcttcgggatcatattaatattgttatttctaaagatattgattttgaaactttggccgagaatccttgtaaagtagggctccaggcagcaaacatagaaggtgcttggggttcaggtgtcgggttcacactcacatgccaggtgtctctcacagaatgcccaacatttctcacgtcaataaaggcctgtgacatggcaatttgttatggtgcagaaagtgtgacactctcacgagggcaaaatactgtcaaaattaccgggaaaggtggccatagtggttcttcatttaaatgctgtcatgggaaagaatgttcatcaactggccttcaagccagtgcaccacatctggataaggtcaatggtatctctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctgctgctcttttctcttatcctgttgagcatcttgtgtcctgttagaaagcataaaaaatcataa

SEQ ID NO: 3486 - RNA, 3402 nt, synthetic construct
  misc_feature 1..3402: note = derived and/or modified CDS sequence (wt) from SEOV(DN2)__KX289953.1__GP
  source 1..3402: mol_type = other RNA
atgtggagtttgctattactggccgctttagctggccaaggttttgcattaaaaaatgtgtttgacatgagaattcagtgtccccattcagttaactttggggaaacaagtgtgtcaggctacacagaattgcccccactctcattacaggaggcagaacaattagtgccagagagctcatgcaacatggacaaccaccaatcactctcaacaataaataaattaaccaaggtcatatggcggaaaaaagcaaatcaggagtcagcaagccagaattcatttgaagttgtggagagtgaagttagctttaaagggttgtgtatgttaaagcatagaatggttgaagaatcatatagaaacaggagatcagtaatctgttatgatctagcctgtaatagtacattctgtaagccaactgtatacatgattgttcctatacatgcttgcaacatgatgaaaagctgtttgattggccttggtccctacagaatccaggttgtctatgagaggacttactgcactacgggtatattgacagaaggaaaatgctttgtccccgacaaggctgttgtcagtgcattgaagagaggcatgtatgccatagcaagcatagagacaatctgcttttttattcatcagaaagggaatacatataagatagtgactgccattacatcagcaatgggctctaaatgtaataatacagatactaaagttcaaggatattatatctgtattattggtggaaactccgcccctgtatatgcccctgctggtgaagacttcagggcaatggaggttttttctgggattattacatcaccgcatggagaagaccatgacctccctggcgaagaaatcgcaacataccagatttcagggcagatagaggcaaaaatccctcatacagtgagctcaaaaaacttaaaattgactgcttttgcaggtattccatcatactcatcaactagtatattagctgcttcagaagatggtcgttttatatttagtcctggcttgtttcctaaccttaatcagtcagtctgtgacaacaatgcactccctttaatctggaggggcctaattgatttaacgggatactatgaggcagtccacccttgcaatgtattctgtgtcttatcaggaccaggtgcttcatgtgaagccttttcagaaggaggtattttcaatataacttctccaatgtgtctggtgtctaagcaaaataggtttagagcagctgagcagcagatcagctttgtctgccaaaggattgatatggatattatagtgtattgtaatggtcagaaaaagacaattttaacaaaaacattagttataggccagtgtatttacactattacaagtctcttttcactgctaccaggggttgcccattctattgctattgagttgtgtgttccagggtttcatggctgggccacagctgcacttttaatcacattctgctttggctgggtattgattcctgcatgtacattagctattcttttagttctcaagttttttgcaaatatccttcacacaagcaatcaagagaaccgatttaaagccatcctacggaaaataaaggaggagtttgaaaaaacaaagggttccatggtttgtgagatctgtaaatacgagtgtgaaacattaaaggagttgaaggcacataatctatcatgtgttcaaggggagtgcccatattgctttactcactgtgaaccgacagaaactgcaattcaggcacattacaaagtttgtcaagccacccaccgattcagagaagatttaaaaaagactgtaactcctcagaatattgggccaggttgttatcgaacattaaatcttttcaggtataaaagtaggtgttacattctgacaatgtggactcttcttctcattattgaatccatcctttgggcagcaagtgcagcagaaatcccccttatccccctctggacagataatgctcatggtgttgggagtgttcctatgcatacagatctcgaattagacttttctttgccatccagttctaaatacacatataaaagacatctcacaaacccagttaatgatcaacagagtgtatcattgcacatagaaattgaaagtcaaggcattggtgctgatgttcatcatcttggacactggtatgatgcaagattgaatctaaaaacctcatttcattgttatggtgcctgcacaaaataccaatatccatggcacactgcaaaatgccattttgagaaagattatgagtatgaaaatagctgggcatgcaaccccccagattgcccaggggttggtacaggttgtactgcttgtggattatatctagatcaattgaggccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatccaagttctctcaaggtgacactttattatttttggggcccatggaaggaggtggtataatctttaaacactggtgtacatctacttgtcactttggagaccctggtgatgtcatgggtccaaaagataaaccatttatttgccctgaattcccagggcaattcaggaaaaaatgtaactttgccacaactccagtttgtgaatatgatgggaataccatctcaggctataagaaagttcttgcaacaattgattcgttccaatcatttaacacaagcaatatacacttcactgatgaaagaattgaatggagagaccctgatggtatgcttcgggatcatattaatattgttatttcaaaagatattgattttgaaaatttggctgagaatccttgtaaagtagggctccaggcagcaaacatagaaggtgcttggggttcaggtgttgggtttacactcacatgccaggtgtctctcacagaatgcccaacatttctcacatcaataaaggcctgtgacatggccatttgttatggtgcagaaagtgtgacactctcacgaggacaaaatactgtcaaaattaccgggaaaggtggccatagtggttcttcatttaaatgctgtcatgggaaagaatgttcatcgactgggcttcaagccagtgcaccacatctggataaggtaaatggtatctctgagttagaaaatgagaaggtttatgatgatggtgcacctgaatgtggcattacttgttggtttaaaaaatcaggtgaatgggttatgggtataatcaatgggaactgggttgtcctaattgttttgtgtgtcttgttgctcttttctcttatcctgttgagcattttgtgtcctgtaagaaagcataaaaaatcataa

SEQ ID NO: 3487 - RNA, 3402 nt, synthetic construct
  misc_feature 1..3402: note = derived and/or modified CDS sequence (wt) from SEOV(IR162)__KX079475.1__GP
  source 1..3402: mol_type = other RNA
atgtggagtttgctattactggccgctttggttggccgaggctttacattaaaaaatgtttttgacatgagaatccagtgtccccactcagtcaattttggggaaacaagtgtgtcaggctatacggaactgcccccactctcattgcaagaggcagaacagctagtgccagaaagctcatgcaacatggacaaccaccaatcactctcaacaataaataaattgaccaaggtcatatggcggaagaaagcaaatcaggaatcagcaaaccagaattcatttgaagttgtggagagtgaagtcagctttaaaggattgtgtatgttaaagcatagaatggttgaagaatcatatagaaacaggagatcagtaatctgttatgatctagcctgtaacagtacattctgtaagccaactgtttacatgattgttcctatacatgcctgcaacatgatgaaaagctgtttgattggccttggtccctatagaatccaggttgtctatgaaaggacatattgcactacaggtatattgacagaaggaaaatgctttgtccctgacaaggctgttgtcagtgcattgaagagaggcatgtatgccatagcaagcatagagacaatctgcttttttattcatcagaaagggaacacatataagatagtgactgccattacatcggcaatgggctccaaatgtaataatacagatactaaagttcaaggatattatatctgtattattggtggaaactccgcccctgtatatgcccctgctggtgaagactttagggcaatggaggttttttctgggatcattacatcaccacatggagaagaccatgatctccctggtgaagaaattgcaacataccagatttcagggcagatagaggcaaaaatccctcatacagtgagctctaaaaacttaaaattgactgcttttgcaggtattccatcatactcatcaaccagtgtactgattgcttcagaagatggtcgtttcatatttagccctggcctattccctaacctaaatcagtcagtctgtgacaacaatgcactccctttaatctggaggggtctaattgatttaacaggatactatgaggcagttcacccttgtaatgtattctgtgtcttatcaggaccaggtgcttcatgcgaagccttttcagaaggaggtatttttaatattacttctccaatgtgtctggtgtccaaacagaataggtttagagcagctgagcagcagatcagctttgtttgccaaagggttgatatggatattatagtgtactgtaatggtcaaaaaaagacaatcttaacaaaaacattagttataggccaatgtatttatactattacaagtctcttttcactgttaccaggggttgcacattctattgctattgagctgtgtgttccagggtttcatggctgggccacggctgcacttttgatcacattctgctttggctgggtattaattcctgcatgtacattagctattcttttagtcctcaagttttttgcaaatatccttcatacaagcaatcaagaaaaccgattcaaagccatcttacggaaaataaaggaggagtttgaaaaaacaaaaggttccatggtttgtgagatctgtaagtacgagtgtgaaacattaaaggaattgaaggcccataatctgtcatgtgttcaaggggagtgcccatattgttttacccactgtgaaccaacagaaactgcaattcaggcacattataaagtttgtcaagctacccaccgattcagagaagatttaaaaaagactgtaactcctcaaaatattggaccaggctgttaccggacactaaatcttttcaggtataaaagtaggtgttatattctaacaatgtggactctccttctcattattgaatccatcctctgggcagcaagtgcaacagaaattccccttgtccctctctggacagataatgcacacggcgtcgggagtgtgcctatgcatacagatcttgaattagacttttctttaccatctagctctaagtacacatataaaagacatctcacaaacccagtcaatgaccaacagagtgtctcattgcatatagaaattgaaagccaaggaatcggtgctgatgttcatcatcttggacattggtatgatgcaagattaaatctaaaaacctcatttcattgttatggtgcctgcacaaaatatcaatatccatggcacactgcaaaatgtcattttgagaaagattatgagtatgaaaatagctgggcgtgcaaccccccagattgcccagggattggtacaggctgtactgcttgtggattatatctagatcaactgaagccggtaggaacagccttcaaaattataagtgtaagatacagcagaaaagtgtgtgtgcaatttggtgaagaatacctttgtaaaacgattgatatgaacgattgctttgtgaccaggcatgccaaaatatgtataattgggactgtatctaagttttctcaaggtgacactctactatttcttgggcccatggaaggaggtggtataatctttaaacactggtgtacatctacctgtcactttggagaccctggtgatgtcatgggtccgaaagataaaccatttatttgccctgaattcccaggacaatttaggaaaaaatgtaattttgccacaactccggtttgtgaatatgatgggaacattatttcaggatataagaaagttcttgcaacaattgattctttccagtcattcaacacaagcaatatacacttcactgatgagagaatcgaatggagagaccctgatggtatgcttcgggatcatattaacattgttatttctaaagatattgattttgaaaatttggctgagaatccttgtaaagtagggctccaagcagcaaacatagaaggtgcttggggttcaggtgtcgggtttacactcacatgccaggtgtctctcacagaatgccccacatttctcacgtcaataaaggcttgtgacatggcaatctgttatggtgcggaaagtgtgacactctcacgaggacaaaatactgtcaagattaccgggaagggtggccatagtggttcttcatttaaatgctgtcatgggaaagaatgttcatcaactggcctccaagctagtgcaccgcatctggataaggtaaacggtatctctgatttagaaaacgagaaagtttatgatgatggtgcacccgaatgtggaattacttgttggtttaaaaaatcaggtgaatgggttatgggtataatcaatgggaactgggttgtcctaattgttttatgtgtcctgttactcttttctcttatcctgttgagcattttgtgtcctgttaggaagcataaaaaatcataa

SEQ ID NO: 3488 - RNA, 3402 nt, synthetic construct
  misc_feature 1..3402: note = derived and/or modified CDS sequence (wt) from SEOV(Gou3)__AF145977.2__GP
  source 1..3402: mol_type = other RNA
atgtggggtttactattgctagccgctctggttggccaaggtttagcattaaaaaatgtctttgacatgaagatacagtgccctcattcagtaaactttggggaaacaagtgtgtcaggatatacagagttgcccccactcccactacaggaggcagaacagcttgtgccggaaagctcttgtaacatggacaatcaccaatcactctcaaccatcaataaactgaccaaggtaatatggagaaaaaaggcaaatcaggaatcagcaagtcagaattcatttgaggttgtggaaaatgaggtgagctttaaaggtttatgtatgctaaaacacagaatggtcgaggaatcatatagaaataggaggtcagtaatttgttatgatctggcatgtaatacaacattttgtaagccaactgtctacatgattgtcccaattcatgcttgcaacatgatgaaaagctgtttgatcggacttgggccctacagaatccaggtaatttatgagagaacttattgtactacagggatactgacagaaggaaagtgttttgtccctgataaggctgttgttagtgctttaaagagaggtatgtatgcaatagctagcatagaaacaatttgtttctttgttcataaaaaaggaaacacatacaaaatagtatcagcaatcacattagcaatgggctccaaatgcaataatacagattctaaggtccaaggatactacatatgcattattggtgggaattcagctcctgtttatgctcctgctggtgaagatttcagggcaatggaagttttttcaggaattattacatcaccacatggggaagatcatgacctcccaggtgaagagatagcaacataccagatctcaggtcaaatagaggctaagatcccccatactgtgagctctaaaaatctaaagcttactgcttttgcaggcattccatcttactcatcaacaagtatcttggctgcatcagaggatggcaggtttatattcagtccgggtttatttccaaatcttaatcagtctgtgtgtgataacaatgcacttcccttaatctggaggggtttaatagatttgacaggttactatgaagcaattcatccttgcaatgttttttgtgttttatcaggaccaggtgcatcatgtgaagctttttcagaaggtggtatttttaatatcacttctccgatgtgcctagtgtcaaaacaaaacagatttagggcagcagaacagcaaattagctttatttgtcaaagagtggatatggatatagttgtgtactgtaatgggcaaaaaaagacaattctgaccaaaacactagttattggccagtgcatatatactataacaagtctattttctttattacctggggttgcacattctattgctattgaactatgtgtaccaggtttccatggctgggctacagcagcacttctagttaccttctgttttggttgggttttaatccctgcatgtacattagctgttctattattcttaaagttttttgcaaatatcttacatacaagcaaccaagaaaacagattcaaggctatcctacgaaaaataaaggaggaatttgaaaaaacaaagggctcaatggtgtgtgaaatttgtaaatatgaatgtgaaacactaaaggaattaaaagctcacaatttgtcctgtgttcaaggggagtgcccatattgcttcacccattgcgagccaactgaaacagcaattcaggcccattataaagtctgtcaagctacccatcggttcagggaagatttaaaaaagactgtaacccctcaaaatattgggccaggttgttaccgtacactaaatctttttaggtacaagagcaggtgttatatcctgacaatgtggattctccttcttgtcattgaatctatattgtgggcagctagtgcagcagagattccccttgtccctttatggacagataatgcccatggagttggcagtgttccaatgcatacagatctggagcttgacttttccttaccatctagctctaaatacacatataaaaggcatcttacaaatccagtgaatgatcaacaaagtgtatcattacatattgaaatcgaaagccagggcattggtgctgatgttcaccatctcggacactggtatgatgcaagattaaacttaaagacatcatttcactgttatggtgcctgcacaaagtatcagtacccatggcatacagcaaaatgccacttcgagaaggattatgaatatgagaatagttgggcatgtaatccacctgattgccctggtgttggggcaggctgtactgcctgtgggctttacttagatcaattaaagccagtaggaacagcttttaaaattataagcgtcagatatagtaggaaagtttgtgtccaatttggtgaagagtacctttgtaaaacaattgatatgaatgattgttttgtgactaggcatgccaagatctgtataatcgggactgtgtccaagttttctcaaggtgacactttattatttcttggacctatggaaggaggcggaattatcttcaaacattggtgcacatcaacctgccattttggagaccctggcgatgtcatgggcccaaaagataagccatttatatgtcccgaatttccaggccagttcagaaaaaaatgtaattttgctacgactccagtctgtgagtatgatggaaatgtcatttctggttatcggaaagttctggcaacaattgattcttttcaatcatttaatactagcaatgttcactttacagatgagaggattgaatggaaagatcctgacggtatgcttcgagaccatattaatattgtcatctctaaagatattgattttgaaaacttggctgaaaacccttgtaaagtaggccttcaagcagctaatatagaaggtgcctggggctcaggtgttggttttacacttacttgtcaagtatcgcttacagaatgcccaacatttctaacatctatagaggcttgtgacatggcaatttgttatggagcagaaagtgtaacactatcacggggccaaaacactataaaaatcacaggaaagggaggtcacagtggttcttccttcaaatgttgccatggtaaagagtgctcagcaaatggccttcaggcaagtgccccacatttggataaagtgaacggtatttctgagttagaaaatgaaaaggtttatgatgatggtgcacctgaatgtggtatcacttgttggttcaagaaatcaggtgaatgggttatgggtatcattaatggaaactgggttgtgttaattgtgttgtgtgtgttacttttgttttcacttattttgctaagcatattgtgtcctgttagaaagcataagaagtcatga

SEQ ID NO: 3489 - RNA, 3402 nt, synthetic construct
  misc_feature 1..3402: note = derived and/or modified CDS sequence (wt) from SEOV(HB55)__AF035832.1__GP
  source 1..3402: mol_type = other RNA
atgtggagtttgctattactggccgctttagttggccaaggctttgcattaaaaaatgtttttgacatgagaattcagtgtccccactcagtcaactttggggaaacaagtgtgtcaggctatacagaattgcccccactctcattacaagaggcagaacagctagtgccagagagctcatgcaacatggacaaccaccaatcactctcaacaataaataaattaaccaaggtcgtatggcgaaaaaaagcaaatcaggaatcagcaaaccagaattcatttgaagttgtggagagtgaagtcagctttaaagggttatgtatgttaaagcatagaatggttgaagaatcatatagaaacagaagatctgtaatctgttatgatctagcctgtaatagtacattctgtaagccaactgtttacatgattgttcctatacatgcttgcaacatgatgaaaagttgtttgattggccttggtccctacagaattcaggttgtctatgaaaggacatactgcactacgggtatattgacagaaggaaaatgttttgtccccgacaaggctgttgtcggtgcattgaagagaggcatgtatgccatagcaagcatagagacaatctgcttttttattcatcagaaagggaataaatataaaatagtgactgccatcacatcagcaatgggctccaagtgcaataatacagatactaaggtccaaggatattatatctgtattattggtggaaactctgctcctgtatatgcccctgctggtgaagactttagggcaatggaggttttttctgggattattacgtcaccgcatggagaagaccatgacctccctggcgaagaaatcgcaacataccagatttcagggcagatagaggcaaaaatccctcatacagtgagctctaaaaacttgaaattgattgcctttgcaggtattccatcatactcatcaactagtatattggctgcttcagaagacggtcgtttcatatttagtcctggtttatttcctaatttaaatcagtcagtctgtgacaacaatgcactccctttaatctggaggggcctaattgacttaacgggatactatgaggcagtccacccttgcaatgtattctgtgtcttatcaggaccaggtgcttcatgtgaagccttttcagagggaggtattttcaacattacttctccaatgtgtctggtgtccaagcaaaataggtttagagcagctgagcagcaaatcagctttatttgccaaagggttgatatggatattatagtgtactgtaatggtcaaaaaaagacaatattaacaaaaacattagttataggccagtgcatttatactattacaagcctcttttcactgttaccaggggttgcccattcgattgctattgagttgtgtgttccaggttttcatggctgggccacagctgcacttttgatcacattttgctttggctgggtattgattcctgcatgcacattagctattcttttagtcctaaagttttttgcaaatatccttcatacaagcaatcaagagaaccgattcaaagccattctacggaaaatcaaggaggagtttgaaaaaacaaagggttccatggtttgtgagatctgtaagtacgagtgtgaaacattaaaggaattaaaggcacataatttatcatgtgtgcaaggggagtgcccatattgctttacgcactgtgaaccgacagaaactgcaattcaggcacattacaaagtttgtcaagccacccaccgattcagagaagatttaaaaaagactgtaactcctcaaaatattgggccaggctgttaccgaacattaaatctttttaggtataaaagtaggtgttatattctaacaatgtggactcttcttctcattattgaatccatcctctgggcggcaagtgcagcagaaatccctcttgtccctctctggacagacaatgctcatggcgttgggagcgttcctatgcatacggatcttgaattagacttttctttgccatctagctctaagtacacatataaaaggcatctcacaaacccagttaatgaccaacagagtgtctcattgcatatagaaattgaaagtcaaggcattggtgctgatgtccaccatcttggacattggtatgatgcaaggttaaatctgaaaacctcattccattgttatggtgcctgcacaaaataccaatatccatggcacactgcaaaatgccattttgagaaagattatgagtatgaaaatagctgggcatgcaaccccccagattgtccaggggttggtacaggttgtactgcctgtggattatatctagatcaattgaagccagtaggaacagcctttaaaattataagtgtaagatatagtagaaaagcgtgcgtgcagtttggtgaagaatacctttgcaaaacaattgatatgaatgattgctttgtgactgggcatgccaaaatatgtataattgggactgtatctaagttttctcaaggtgacactctactatttcttggacccatggaaggaggtggtataatctttaaacactggtgtacatctacctgtcactttggagaccctggtgatgtcatgggtccaaaagataaaccatttatttgccctgaattcccagggcaattcaggaaaaaatgtaactttgccacaactccaatttgtgaatatgatgggaacattatctcaggttataagaaagtccttgcaacaattgattcttttcaatcatttaacacaagcaatatacacttcactgatgagagaattgaatggagagaccctgatggtatgcttcgggatcatattaatatcgttatttctaaagatattgattttgaaaatttggctgagaatccttgtaaagtagggctccaggcagcaaacatagaaggtgcttggggttcaggtgtcgggtttacactcacatgccaggtgtctctcacagaatgcccaacatttcttacgtcaataaaggcctgtgacatggcaatttgttatggtgcagaaagtgtgacactttcacgaggacaaaatactgtcaggattactggaaaaggtggccatagtggttcttcatttaaatgctgtcatgggaaagaatgttcatcaactggcctccaagccagtgcaccacatttggataaagtaaatggtatctctgagttagaaaacgagaaagtttatgatgatggtgcacctgaatgtggcgttacttgttggtttaaaaaatcaggtgaatgggttatgggtataatcaacgggaactgggttgtcctaattgttttgtgtgtcctgttgctcttttctcttatcctgttaagcattttgtgtcctgttagaaagcataaaaaatcataa

SEQ ID NO: 3490 - RNA, 3402 nt, synthetic construct
  misc_feature 1..3402: note = derived and/or modified CDS sequence (wt) from SEOV(L99)__AF035833.1__GP
  source 1..3402: mol_type = other RNA
atgtggagtttgctattactggccgctttagttggccaaggctttgcattaaaaaatgtttttgacatgagaattcagtgtccccactcagtcaactttggggaaacaagtgtgtcaggctatacagaattgcccccactctcattacaagaggcagaacagctagtgccagagagctcatgcaacatggacaaccaccaatcactctcaacaataaataaattaaccaaggtcgtatggcgaaaaaaagcaaatcaggaattagcaaaccagaattcatttgaagttgtggagagtgaagtcagctttaaagggttatgtatgttaaagcatagaatggttgaagaatcatatagaaacagaagatctgtaatctgttatgatctagcctgtaatagtacattctgtaagccaactgtttacatgattgttcctatacatgcttgcaacatgatgaaaagttgtttgattggccttggtccctacagaattcaggttgtctatgaaaggacatactgcactacgggtatattgacagaaggaaaatgttttgtccccgacaaggctgttgtcagtgcattgaagagaggcatgtatgccatagcaagcatagagacaatctgcttttttattcatcagaaagggaatacatataaaatagtgactgccatcacatcagcaatgggctccaagtgcaataatacagatactaaggtccaaggatattatatctgtattattggtggaaactctgctcctgtatatgcccccgctggtgaagactttagggcaatggaggttttttctgggattattacgtcaccgcatggagaagaccatgacctccctggcgaagaaatcgcaacataccagatttcagggcagatagaggcaaaaatccctcatacagtgagctctaaaaacttgaaattgattgcctttgcaggtattccatcatactcatcaactagtatattggctgcttcagaagacggtcgtttcatatttagtcctggtttatttcctaatttaaatcaatcagtctgtgacaacaatgcactccctttaatctggaggggcctaattgacttaacgggatactatgaggcagtccacccttgcaatgtattctgtgtcttatcaggaccaggtgcttcatgtgaagccttttcagagggaggtattttcaacattacttctccaatgtgtctggtgtccaagcaaaataggtttagagcagctgagcagcaaatcagctttatttgccaaagggttgatatggatattatagtgtactgtaatggtcaaaaaaagacaatattaacaaaaacattagttataggccagtgcatttatactattacaagtctcttttcactgttaccaggggttgcccattctattgctattgagttgtgtgttccaggttttcatggctgggccacagctgcacttttgatcacattttgctttggctgggtattgattcctgcatgcacattagctattcttttagtcctaaagttttttgcaaatatccttcatacaagcaatcaagagaaccgattcaaagccattctacggaaaatcaaggaggagtttgaaaaaacaaagggttccatggtttgtgagatctgtaagtacgagtgtgaaacattaaaggaattaaaggcacataatttatcatgtgtgcaaggggagtgcccatattgctttacgcactgtgaaccgacagaaactgcaattcaggcacattacaaagtttgtcaagccacccaccgattcagagaagatttaaaaaagactgtaactcctaaaaatattgggccaggctgttaccgaacattaaatctttttaggtataaaagtaggtgttatattctaacaatgtggactcttcttctcattattgaatctatcctctgggcggcaagtgcagcagaaatccctcttgtccctctctggacagataatgctcatggcgttgggagcgttcctatgcatacggatcttgaattagacttttctttgccatctagctctaagtacacatataaaaggcatctcacaaacccagttaatgaccaacagagtgtctcattgcatatagaaattgaaagtcaaggcattggtgctgatgtccaccatcttggacattggtatgatgcaaggttaaatctgaaaacctcattccattgttatggtgcctgcacaaaataccaatatccatggcacactgcaaaatgccattttgagaaagattatgagtatgaaaatagctgggcatgcaaccccccagattgtccaggggttggtacaggttgtactgcctgtggattatatctagatcaattaaagccggtaggaacagcctttaaaattataagtgtaagatatagtagaaaagtgtgcgtgcagtttggtgaagaatacctttgcaaaacaattgatatgaatgattgctttgtgactaggcatgccaaaatatgtataattgggactgtatctaagttttctcaaggtgacactctactatttcttggacccatggaaggaggtggtataatctttaaacactggtgtacatctacctgtcactttggagaccctggtgatgtcatgggtccaaaagataaaccatttagttgccctgaattcccagggcaattcaggaaaaaatgtaactttgccacaactccaatttgtgaatatgatgggaacattatctcaggttataagaaagtccttgcaacaattgattcttttcaatcatttaacacaagcaatatacacttcactgatgagagaattgaatggagagaccctgatggtatgcttcgggatcatattaatatcgttatttctaaagatattgattttgaaaatttggctgagaatccttgtaaagtagggctccaggcagcaaacatagaaggtgcttggggttcaggtgtcgggtttacactcacatgccaggtgtctctcacagaatgcccaacatttcttacgtcaataaaggcctgtgacatggcaatttgttatggtgcagaaagtgtgacactttcacgaggacaaaatactgtcaggattactggaaaaggtggccatagtggttcttcatttaaatgctgtcatgggaaagaatgttcatcaactggcctccaagccagtgcaccacatttggataaagtaaatggtatctctgagttagaaaacgagaaagtttatgatgatggtgcacctgaatgtggcgttacttgttggtttaaaaaatcaggtgaatgggttatgggtataatcaacgggaactgggttgtcctaattgttttgtgtgtcctgttactcttttctcttatcctgttaagcattttgtgtcccgttagaaagcataaaaaatcataa

SEQ ID NO: 3491 - RNA, 3402 nt, synthetic construct
  misc_feature 1..3402: note = derived and/or modified CDS sequence (wt) from SEOV(Z37)__AF187081.1__GP
  source 1..3402: mol_type = other RNA
atgtggagtttgctattattggccgctttagttggccaaggcttcgcattaaaaaatgtgtttgacatgagaattcagtgtccccactcagtcaactttggggaaacaagtgtgtcaggctatacagaattgccaccactctcattacaggaggcagaacagctagtgccagagagctcatgcaacatggacaaccaccaatcactctcaacaataaataaattaactaaggtaatatggcggaaaaaagcaaatcaggaatcagcaaaccagaattcatttgaagttgtggagagtgaagtcagctttaaagggttgtgtatgttaaagcatagaatggttgaagagtcatatagaaacaggagatcagtaatctgttatgatctagcctgtaatagtacattttgtaagccaactgtttacatgattgttcctatacatgcatgcaacatgatgaaaagctgtttgattggccttggtccctatagaatccaggttgtctatgaaaggacatactgcactacaggtatattgacagaaggaaagtgctttgtccccgacaaggctgttgtcagtgcattgaagagaggcatgtatgccatagcaagcatagagacaatctgcttttttattcatcaaaaagggaataaatataagatagtgactgccatcacatcagcaatgggctccaaatgtaataatacagatactaaagttcagggatattatatctgtattattggtggaaactctgcccctgtatatgcccctgctggtgaagactttagggcaatggaggttttttctgggattattacgtcaccgcatggagaagaccatgacctccctggcgaagaaatcgcaacataccagatttcagggcagatagaggcaaaaatccctcatacagtaagctctaaaaacttaaaattgactgcttttgcaggtattccatcatactcatcaactagtatattggctgcttcagaagatggtcgttttatatttagtcctggtttatttcctaacctaaatcagtcagtctgtgataacaatgcactccctttaatctggaggggcctaattgatttaacgggatactatgaggcagtccatccctgcaatgtattctgtgtcttatcaggaccaggtgcttcatgtgaagccttttcagaaggaggtattttcaatattacttctccaatgtgtctggtgtctaagcaaattaggtttagagcagctgagcagcagatcagctttatctgccaaagggtcgatatggatattatagtgtactgtaatggtcaaaaaaagacaatcctaacaaaaacattagttataggtcaatgcatttatactattacaagtctcttttcactgttgccaggggttgcccattctattgctattgagttgtgtgttccagggtttcatggctgggccacagctgcacttttgatcacattttgctttggctgggtattaattcctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtgtgtcaagccactcaccgattcagagaagatttaaaaaagactgtaactcctcaaaatattggaccaggctgttaccgaacattgaatcttttcaggtataaaagtaggtgttatattctgacaatgtggactcttcttctcattattgaatccatcctctgggcggcaagtgcagcagaaatcccccttgtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttgggcattggtatgatgcaaggttgaacctaaaaacttcatttcactgctacggtgcctgcacaaaataccaatatccgtggcacaccgcaaagtgtcattttgagaaagattatgagtatgaaaatagttgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacacactactatttcttgggcccatggaaggaggtggtataatctttaaacactggtgtacatctacctgtcactttggagaccctggtgatgttatgggtccaaaagataaaccatttatttgccctgaattcccagggcaattcaggaagaaatgtaattttgccacaactccagtttgtgaatatgatgggaacattatttcaggctataagaaagttcttgcaacaattgattctttccaatcatttaacacaagcaatatacacttcactgatgagagaattgaatggagagaccctgatggtatgcttcgggatcatattaatattgttatttctaaagatattgattttgaaaatttggccgagaatccttgtaaagtagggctccaggcagcaaacatagaaggtgcttggggttcaggtgtcgggttcacactcacatgccaggtgtctctcacagaatgcccaacatttctcacgtcaataaaggcctgtgacatggcaatttgttatggtgcagagagtgtgacactctcacgagggcaaaatactgtcaaaattaccgggaaaggtggccatagtggttcttcatttaaatgctgtcatgggaaagaatgttcatcaactggccttcaagccagtacaccacatctggataaggtcaatggtatctctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctgctgctcttttctcttatcctgttgagcatcttgtgtcctgttagaaagcataaaaaatcataa

SEQ ID NO: 3492 - RNA, 3402 nt, synthetic construct
  misc_feature 1..3402: note = derived and/or modified CDS sequence (wt) from SEOV(Z37)__AF190119.1__GP
  source 1..3402: mol_type = other RNA
atgtggagtttgctattactggccgctttagttggccaaggctttgcattaaaaaatgtgtttgacatgagaattcagtgtccccactcagtcaactttggggaaacaagtgtgtcaggctatacagaattgccaccactctcattacaggaggcagaacagctagtgccagagagctcatgcaacatggacaaccaccaatcactctcaacaataaataaattaactaaggtaatatggcggaaaaaagcaaatcaggaatcagcaaaccagaattcatttgaagttgtggagagtgaagtcagctttaaagggttgtgtatgttaaagcatagaatggttgaagagtcatatagaaacaggagatcagtaatctgttatgatctagcctgtaatagtacattttgtaagccaactgtttacatgattgttcctatacatgcatgcaacatgatgaaaagctgtttgattggccttggtccctatagaatccaggttgtctatgaaaggacatactgcactacaggtatattgacagaaggaaagtgctttgtccccgacaaggctgttgtcagtgcattgaagagaggcatgtatgccatagcaagcatagagacaatctgcttttttattcatcagaaagggaatacatataagatagtgactgccatcacatcagcaatgggctccaaatgtaataatacagatactaaagttcagggatattatatctgtattattggtggaaactctgcccctgtatatgcccctgctggtgaagactttagggcaatggaggttttttctgggattattacgtcaccgcatggagaagaccatgacctccctggcgaagaaatcgcaacataccagatttcagggcagatagaggcaaaaatccctcatacagtaagctctaaaaacttaaaattgactgcttttgcaggtattccatcatactcatcaactagtatattggctgcttcagaagatggtcgttttatatttagtcctggtttatttcctaacctaaatcagtcagtctgtgataacaatgcactccctttaatctggaggggcctaattgatttaacgggatactatgaggcagtccatccctgcaatgtattctgtgtcttatcaggaccaggtgcttcatgtgaagccttttcagaaggaggtattttcaatattacttctccaatgtgtctggtgtctaagcaaaataggtttagagcagctgagcagcagatcagctttatctgccaaagggtcgatatggatattatagtgtactgtaatggtcaaaaaaagacaatcctaacaaaaacattagttataggtcaatgcatttatactattacaagtctcttttcactgttgccaggggttgcccattctattgctattgagttgtgtgttccagggtttcatggctgggccacagctgcacttttgatcacattttgctttggctgggtattaattcctgcatgtacattagctattcttctagttctcaagttttttgcaaatatccttcatacaagcaatcaagagaatcgattcaaagccattctacggaaaataaaggaggagtttgaaaaaacaaagggttccatggtttgtgagatctgtaagtacgagtgtgaaacattaaaggaattgaaggcacataatctatcatgtgttcaaggggagtgcccatattgctttacccactgtgaaccgacagaaactgcaattcaggcacattacaaagtgtgtcaagccactcaccgattcagagaagatttaaaaaagactgtaactcctcaaaatattggaccaggctgttaccgaacattgaatcttttcaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacagatcttgaattagacttttctttgccatctagttctaagtacacatataaaagacatcttacaaacccagttaatgaccaacagagtgtctcattgcatatagaaattgaaagtcaaggcattggtgctgatgttcatcatcttgggcattggtatgatgcaaggttgaacctaaaaacttcatttcactgctacggtgcctgcacaaaataccaatatccgtggcacaccgcaaaatgtcattttgagaaagattatgagtatgaaaatagttgggcatgcaaccccccagattgcccaggggttggtacaggttgtactgcttgtggattatatctagatcaattgaagccggtaggaacagccttcaaaattataagtgtaagatacagtagaaaagtgtgcgtgcagtttggtgaagaatacctttgtaaaacaattgatatgaatgattgctttgtgactaggcatgccaaaatatgtataattgggactgtatctaagttttctcaaggtgacacactactatttcttgggcccatggaaggaggtggtataatctttaaacactggtgtacatctacctgtcactttggagaccctggtgatgttatgggtccaaaagataaaccatttatttgccctgaattcgcagggcaattcaggaagaaatgtaattttgccacaactccagtttgtgaatatgatgggaacattatttcaggctataagaaagttcttgaaacaattgattctttccaatcatttaacacaagcaatatacacttcactgatgagagaattgaatggagagaccctgatggtatgcttcgggatcatattaatattgttatttctaaagatattgattttgaaaatatggccgagaatccttgtaaagtagggctccaggcagcaaacatagaaggtgcttggggttcaggtgtcgggttcacactcacatgccaggtgtctctcacagaatgcccaacatctctcacgtcaataaaggcctgtgacatggcaatttgttatggtgcagaaagtgtgacactctcacgagggcaaaatactgtcaaaattaccgggaaaggtggccatagtggttcttcatttaaacgctgtcatgggaaagaatgttcatcaactggccttcaagccagtgcaccacatctggataaggtcaatggtatctctgagttagaaaacgagaaagtttatgatgatggtgcacctgaatgtggcattacttgttggtttaaaaaatcaggtgaatgggttatgggtataatcaatgggaactgggttgtcctaattgttttgtgtgtcctgctgctcttttctcttatcctgttgagcatcttgtgtcctgttagaaagcataaaaaatcataa

SEQ ID NO: 3493 - RNA, 3402 nt, synthetic construct
  misc_feature 1..3402: note = derived and/or modified CDS sequence (wt) from SEOV__M34882.1__GP
  source 1..3402: mol_type = other RNA
atgtggagtttgctattactggccgctttagttggccaaggctttgcattaaaaaatgtatttgacatgagaattcagttgccccactcagtcaactttggggaaacaagtgtgtcaggctatacagaatttcccccactctcattacaggaggcagaacagctagtgccagagagctcatgcaacatggacaaccaccagtcactctcaacaataaataaattaaccaaggtcatatggcggaaaaaagcaaatcaggaatcagcaaaccagaattcatttgaagttgtggaaagtgaagtcagctttaaagggttgtgtatgttaaagcatagaatggttgaagaatcatatagaaataggagatcagtaatctgttatgatctagcctgtaatagtacattctgtaaaccaactgtttatatgattgttcctatacatgcttgcaacatgatgaaaagctgtttgattggccttggcccctacagaatccaggttgtctatgaaaggacatactgcactacgggtatattgacagaaggaaaatgctttgtccctgacaaggctgttgtcagtgcattgaaaagaggcatgtatgctatagcaagcatagagacaatctgcttttttattcatcagaaagggaatacatataagatagtgactgccattacatcagcaatgggctccaaatgtaataatacagatactaaagttcaaggatattatatctgtattattggtggaaactccgcccctgtatatgcccctgctggtgaagacttcagagcaatggaggttttttctgggattattacatcaccacatggagaagaccatgacctacccggcgaagaaatcgcaacgtaccagatttcagggcagatagaggcaaaaatccctcatacagtgagctccaaaaacttaaaattgactgcttttgcaggtattccatcatactcatcaactagtatattggctgcttcagaagatggtcgtttcatatttagtcctggtttatttcctaacctaaatcagtcagtctgtgacaacaatgcactccctttaatctggaggggcctaattgatttaacgggatactatgaggcagtccacccttgcaatgtgttctgtgtcttatcaggaccaggtgcttcatgtgaggccttttcagaaggaggtattttcaatattacttctccaatgtgtctggtgtctaagcaaaatagatttagagcagctgagcagcagattagctttgtctgccaaagagttgatatggatattatagtgtactgtaatggtcagaaaaaaacaatcctaacaaaaacattagttataggccaatgtatttatactattacaagtctcttttcactgttaccaggggttgcccattctattgctattgagttgtgtgttccagggtttcatggctgggccacagctgcacttttgattacattctgcttcggctgggtattgattcctgcatgtacattagctattcttttagtccttaagttctttgcaaatatccttcatacaagcaatcaagagaaccgattcaaagccattctacggaaaataaaggaggagtttgaaaaaacaaagggttccatggtttgtgagatctgtaagtatgagtgtgaaacattaaaggaattgaaggcacataacctatcatgtgttcaaggagagtgcccatattgctttacccactgtgaaccgacagaaactgcaattcaggcacattacaaagtttgtcaagccacccaccgattcagagaagatttaaaaaagactgtaactcctcaaaatattgggccaggctgttaccgaacactaaatctttttaggtataaaagtaggtgttatattctgacaatgtggactcttcttctcattattgaatccatcctctgggcagcaagtgcagcagaaatcccccttgtccctctctggacagataatgctcatggcgttgggagtgttcctatgcatacggatcttgaattagacttctctttgccatccagttctaagtacacatacaaaagacatctcacaaacccagttaatgaccaacagagtgtctcattgcatatagaaattgaaagtcaaggcattggtgctgctgttcatcatcttggacattggtatgatgcaagattgaatctaaaaacctcatttcattgttatggtgcctgcacaaaatatcaatacccatggcacactgcaaaatgccattttgagaaagattatgagtatgaaaatagctgggcttgcaaccccccagattgcccaggggttggtacaggttgtactgcttgtggattatatctagatcaattgaagccggtaggaacagcctttaaaattataagtgtaagatacagtagaaaagtgtgcgtgcagtttggtgaagaacacctttgtaaaacaattgatatgaatgattgctttgtgactaggcatgccaaaatatgtataattgggactgtatctaagttttctcaaggtgacactctactatttctggggcccatggaaggaggtggtataatctttaaacactggtgtacatctacctgtcactttggagaccctggtgatgtcatgggtccaaaagataaaccatttatttgccctgaattcccagggcaatttaggaaaaaatgtaactttgccacaactccagtttgtgaatatgatggaaacattatatcaggctataagaaagtacttgcaacaattgattctttccaatcatttaacacaagcaatatacacttcactgatgagagaattgaatggagagaccctgatggcatgcttcgggatcatattaatattgttatttctaaagatattgattttgaaaatttggctgagaatccttgtaaagtagggctccaggcagcaaacatagaaggtgcctggggttcaggtgtcgggtttacactcacatgcaaggtgtctctcacagaatgcccaacatttcttacatcaataaaggcctgtgacatggcaatttgttatggtgcagaaagtgtgacactctcacgaggacaaaatactgtcaaaattaccgggaaaggtggccatagtggttcttcattcaaatgctgtcatgggaaagaatgttcatcaactggcctccaagccagtgcaccacatctggataaggtaaatggtatctctgagttagaaaacgagaaagtttatgatgacggtgcacctgaatgtggcattacttgttggtttaaaaaatcaggtgaatgggttatgggtataatcaatgggaactgggttgtcctaattgtcttgtgtgtactgctgctcttttctcttatcctgttgagcatcttgtgtcctgttagaaagcataaaaaatcataa

SEQ ID NO: 3494 - RNA, 3423 nt, synthetic construct
  misc_feature 1..3423: note = derived and/or modified CDS sequence (wt) from SNV(NM H10)__NC_005215.1__GP
  source 1..3423: mol_type = other RNA
atggtagggtgggtttgcatcttcctcgtggtccttactactgcaactgctgggctaacacggaatctttatgagttgaagatagaatgtccacatactgtgggtttaggtcagggttacgtgacaggttcagtggaaattacacctattctcttaacgcaggtagctgatctgaagattgagagttcttgtaatttcgatttgcatgtcccggctaccactacccaaaaatacaatcaggttgactggaccaaaaaaagttcaactacagaaagcacaaatgcaggtgcaactacatttgaggctaaaacaaaagagataaatttgaaaggcacatgtaatattcctccaactacatttgaagctgcatataaatcaaggaagacagtaatttgttatgatttagcctgtaatcaaacacattgtcttcctacggtccatttgattgctcctgttcaaacgtgcatgtctgtgcggagctgtatgataggtttgctgtcaagcaggattcaagtgatatatgagaagacatactgcgttacaggtcaattaatagaggggctatgtttcatcccaacacatacaattgcactcacacaacctggtcatacctatgatactatgacattgccagtgacttgttttttagtagctaaaaagttgggaacacagcttaagctggctgttgagttagagaaactgattactggtgtaagttgcacagaaaacagctttcaaggttactacatctgttttatcgggaaacattcagagcccttatttgtgccaacaatggaggattataggtcagctgagttatttacccgtatggttttaaatccgagaggtgaagatcatgaccctgatcaaaatggacaaggtttaatgagaatagctgggcctgttacagctaaggtgccatctacagaaacaactgaaacaatgcaaggaattgcatttgctggagcaccaatgtatagctctttctcaaccctcgtgaggaaggctgatcctgagtatgtcttctcaccaggtataattgcagaatcaaatcatagtgtttgtgataaaaaaacagtaccccttacatggacagggtttttggcagtttctggagagatagagaaaataacaggctgtacagtcttctgtacattggctggacctggtgctagttgtgaagcatactcagaaacaggaatctttaatataagttctcctacttgtctagtgaataaagttcaaaaattcagaggctcagaacagaggattaacttcatgtgccaaagagttgatcaagatgtagttgtctattgtaatggacaaaagaaagtcattcttaccaaaactctggtcataggccaatgcatttatacattcactagtttattctcactaatcccaggagttgcccattctcttgctgtagagctatgtgttccaggccttcatggctgggctacaacggcattactgattactttttgctttggctggctccttataccggcagtcaccttaattatactgaagatcctgaggttgctcactttctcatgctcacattattccacagaatcaaaattcaaagttatcttagaaagggttaaggttgaatatcagaaaacaatgggctctatggtgtgtgatatttgccaccacgaatgcgaaacagcaaaagaacttgaaacacataagaaaagctgtccagaaggtcaatgcccgtattgtatgacaataactgaatccactgagagtgctctccaagcccattttgcaatctgtaagctaacaaacaggtttcaggaaaacttaaaaaagtcattgaaacgcccagaagtacggaaaggttgttacaggacactgggagtttttagatacaagagcagatgttatgttggtttagtatggggaattcttttaacaactgaactgatcatatgggcagccagtgcagacacccctttaatggagtctggttggtctgacacagcacatggtgtgggcataattcctatgaagacagatttggagcttgattttgcattggcctcatcatcttcttacagttataggcgaaagcttgttaatcctgctaatcaagaagaaacactcccttttcatttccagttagataaacaagtagtgcatgcagagatccagaacctaggacattggatggatggcacattcaacataaaaactgcttttcactgttatggggagtgtaaaaaatatgcctatccttggcaaacagccaagtgtttctttgaaaaggattatcaatatgaaacaagttggggctgtaatccaccagactgtccaggggtaggtacaggttgtacagcttgtggggtgtaccttgataagctccgttcggttgggaaagcgtacaagatagtatcactcaaatatacacggaaggtgtgtattcaattaggaacagaacaaacttgtaaacatatagatgtaaatgattgcctggttaccccttctgtcaaagtttgtatgattggtactatatcaaagctccagccaggtgataccttgttgttcttaggtcctttagagcagggtgggatcattcttaagcaatggtgtacaacatcatgtgtgtttggagatcccggtgatattatgtcaacaacaagtgggatgcggtgcccagaacatactggatcttttagaaagatctgtgggtttgctacgacaccaacatgtgagtatcaaggcaacacagtgtctggattccaacgcatgatggcaactcgagattctttccagtcattcaatgtgacagaaccacatatcactagcaaccgacttgagtggattgatccagatagcagtatcaaagatcacattaatatggttttaaatcgagatgtttcctttcaggatctaagtgataacccatgcaaggttgacctgcatacacaatcaattgacggggcctggggttcaggagtaggttttacgttggtatgtactgtggggcttacagagtgtgcaaattttataacttcaattaaagcatgtgattctgccatgtgttatggagccacagtgacaaatctgcttagagggtctaacacagttaaagttgttggtaaaggtgggcattctggatctttgtttaaatgctgccatgatactgactgtaccgaagaagggttagcagcatctccaccacatttagacagggttacaggctataatcaaatagattctgataaagtttatgatgacggtgcaccgccctgtacaatcaagtgctggttcaccaagtcaggtgaatggctgttgggaatccttaatggcaattgggtggtagttgctgttctgattgtaattttgatattatcgatactcctttttagctttttttgtcctgtcagaagtagaaagaataaagctaattag

SEQ ID NO: 3495 - RNA, 3423 nt, synthetic construct
  misc_feature 1..3423: note = derived and/or modified CDS sequence (wt) from SNV(1)__JQ690283.1__GP
  source 1..3423: mol_type = other RNA
atggtagggtgggtttgcatcttcctcgtggtccttactactgcaaccgctggattgacacggaatctctatgaattaaagatagaatgcccacatactgtgggtctaggtcagggttatgtgacaggttctgtggaaactacacctattcttttaacacaggtagctgacctcaagattgagagttcttgcaattttgacttgcatgtcccggccactactactcagaaatacaatcaagttgattggactaaaaaaagttctactacagaaagcacgaatgcaggtgcagctacatttgaggctaaaacaaaagaggtaaatttaaaaggcacatgtaatattcctccaactacgtttgaggctgcatacaagtcaaggaagacagtgatttgttatgatttggcctgtaatcagacacattgtcttcctacagtccatttgattgctcctgttcaaacatgtatgtctgtacggagctgtatgataggtctgttatctagcaggatccaggtcatctatgagaagacatattgtgtcacgggtcagttgatagaagggttatgtttcattccaacacatacaattgcacttacacagcctggtcatacgtatgatactatgacattgcctgtaacttgttttttagtggccaaaaaattgggaacacagcttaagctggctgttgagttagagaaattgattactggtgtgagctgcacagagaatagcttccaaggttattacatctgttttatcggaaaacattcagagcccttatttgtaccaacaatggaagattatagatcagctgagttatttacccgtatggttttaaatccaagaggtgaagatcatgatcctgatcagaatggacaagggttgatgagaatagctggacctgttactgccaaggtaccatctacagaaacaaccgaaacaatgcaaggaattgcatttgctggggcaccaatgtatagctcgttctcaactcttgtgagaaaagcagatcctgaatatgtcttttctccaggtataattgcagaatcaaatcatagtgtttgtgataaaaagacagtgcccctcacatggactgggttcctagcagtttcaggagagatagaaaggataacaggctgtacagttttttgtacattggctggacctggtgctagttgcgaagcatactcagaaacaggaatcttcaacataagctccccaacttgtttggtaaataaagttcaaaaatttagaggttcagaacaaagaattaattttatgtgtcaaagggttgatcaagatgttgtggtgtactgtaatggacaaaagaaagtcatccttactaaaaccctagtaataggtcaatgtatctacacatttacaagtttattttcactaattcctggagttgcccattctcttgctgtggagttgtgtgttccaggtcttcatggttgggctacaacagcactacttattactttctgttttggctggcttctcataccaacagttactttaattatactaaaagtcttaaggctgctgactttctcatgctcgcactattctacagaatcaaaattcaaagtcattttagaaagagtcaaggtggagtatcaaaagacaatgggctcaatggtgtgtgatatttgtcaccatgaatgtgagacagcaaaagagcttgaaacacataagaaaagttgtccagaaggtcaatgcccatactgcatgacaataactgagtccactgagagtgcattgcaagctcatttttcaatctgtaagctaacaaataggttccaggaaaatctaaaaaaatcattaaaacgcccagaagtacggaaaggttgttacaggacattaggagttttccgctacaagagcaggtgctatgtcggcttagtatgggggattctcttaacgacagagctgattatatgggctgctagtgcagatacccctctaatggagtctggttggtcagatacagcacatggtgtaggtataattcctatgaaaacagacttagagcttgactttgccctggcctcatcatcctcttatagttatagaagaaagcttgtaaaccctgccaatcaagaggaaacacttccctttcatttccagttagataagcaagtagtgcatgcagagatacagaatttagggcattggatggatggcacatttaacataaagactgcttttcattgctatggagaatgtaaaaaatatgcctatccttggcagacagccaagtgtttctttgaaaaggattatcagtatgaaacaagttggggctgtaacccaccagattgcccaggggtaggaacaggttgtacagcctgtggggtatacttagacaagctccgttcagttgggaaagcctataagattgtatcactcaagtatacacgaaaggtatgtattcaattggggacagaacaaacctgcaaacacatagatgttaatgattgtttagtcaccccgtctgttaaagtttgcatgataggtaccatctcaaagctccagccaggtgataccttattgttcttgggtcctttagagcaaggtgggattattctgaaacaatggtgcacaacatcatgtgtgtttggagaccctggtgatatcatgtcaacaacaagtgggatgagatgccctgagcacactgggtcttttagaaaaatttgtggatttgctacaacacctacatgtgaatatcaaggcaatacagtgtctggattccaacgcatgatggcaactcgagattcctttcaatcattcaatgtgacagaaccacatattaccagcaatcgactcgaatggattgatccagatagtagtattaaggatcatatcaacatggttttaaatagagatgtttccttccaagatttaagtgacaatccatgtaaggttgatttacatacacaatctattgatggagcttggggatcaggagtgggcttcacattagtatgtactgtaggtcttacagagtgtgcaaacttcataacttcaattaaggcatgtgattctgctatgtgttatggggccacagttacaaatctgctcagaggatctaacacagttaaagttgttggtaaaggtgggcattctgggtccttatttaagtgctgccatgatactgactgtactgaagaaggtttagcagcatcaccacctcatttagatagggttactggttacaatcaaatagattctgataaggtttatgatgatggtgcaccgccctgtacaattaaatgttggttcacaaagtcaggtgagtggctgctaggaattcttaatggcaattgggtagtagtcgctgttttgattgtaattttgatactatcaatactcctgttcagctttttttgccctgttaggaataggaagaataaggccaattag

SEQ ID NO: 3496 - RNA, 3423 nt, synthetic construct
  misc_feature 1..3423: note = derived and/or modified CDS sequence (wt) from SNV(1)__JQ690279.1__GP
  source 1..3423: mol_type = other RNA
atggtagggtgggtttgcatcttcctcgtggtccttactactgcaactgctgggttgacacggaatctttatgagttaaagatagaatgtccgcatactgttggtttaggccagggttatgtgacaggttcagtggaaactacacctattctcttgacacaggtagctgacctcaagattgagagttcctgtaattttgatctgcatgtcccggccactactactcaaaaatacaatcaggttgactggaccaaaaagagttctactacagaaagcacaaatgcaggtgcaaatacatttgaggctaaaacaaaggaaataaatttgaaaggcacatgcaacattcctccaactacatttgaggctgcatacaaatcaaggaaaacagtgatctgttatgatctagcctgtaatcaaacacactgtcttccaacagtgcatttaattgctcctgtccaaacatgcatgtctgtacgaagctgtatgataggcttattgtccagtaggattcaagtcatctatgagaaaacatattgtgtcacaggtcaattaatagaagggttatgcttcattccaacacacacaattgcacttacgcagcctggtcatacttatgacactatgacattaccagtaacttgttttttggtagcaaaaaaactgggaacacaactcaagttagctgtggagttagaaaaattaattactggtgtgagctgtacagaaaatagtttccaaggttattacatctgctttattgggaaacattcagagcccctatttgtgccaacaatggaggattataggtcagctgaattatttactcgtatggttttaaatccaagaggtgaagatcatgatcctgatcagaatgggcaaggtttgatgagaatagctggacctgttactgctaaggtaccatctacagaaacaactgaaacaatgcaaggaattgcatttgctggagcaccaatgtatagttcattttcaactcttgtgaggaaggctgatcctgagtatgtcttttccccgggtataattgcagaatcaaatcatagtgtctgtgataagaaaacagtacccctcacatggactggatttttggcagtctcaggagaaatagaaaggataacaggctgtacagtcttttgtactttggctggacctggcgcaagctgtgaggcatactcagagacaggaatcttcaatataagttcccccacttgtctggttaataaagttcaaaaattcagaggttcagagcaaagaatcaacttcatgtgtcagagggttgatcaagatgtagtagtctactgtaatggacaaaagaaagtcattctcactaagactctagttataggccaatgtatttatacattcaccagtttattttcactgattccaggagttgctcattctcttgctgtagaattatgtgttcctgggctgcatggttgggcaacaactgcattacttatcacattttgttttggctggctccttataccaacagttaccttacttatattaaaaatcctgaggttgcttactttttcatgctcacattattctacagagtcaaaattcaaagtcatcttggaaagggtaaaggtggaatatcaaaaaacgatgggctcaatggtgtgtgacatttgccatcatgaatgtgaaacagctaaagaacttgaaacacataagaagagttgcccggaaggtcagtgcccatactgcatgacaataactgaatccactgaaagtgctctacaagctcatttctcaatctgtaagttaactaacaggtttcaggaaaatttaaagaagtcattaaaacgcccagaagtgaagaaaggttgttacaggacactaggggtatttcggtataagagtcggtgttatgttggtctagtatggggaattcttctaacaactgagctaattatatgggcagctagcgctgacacccccttaatggagtctggttggtctgatacagcacatggagttggcataattcccatgaaatcagatttagagcttgatttcgcactggcttcatcgtcttcttatagttataggagaaaacttgtaaatcctgccaatcaagaagaaacacttcctttccatttccagctagacaaacaagtagttcatgcagagatacagaatctagggcattggatggatggcacattcaacataaaaactgctttccattgttatggagaatgtaaaaaatatgcttatccctggcagacagcaaagtgtttctttgaaaaggattaccagtatgagacaagttggggctgtaacccaccagattgcccaggggtaggtacaggctgtacagcctgtggggtataccttgacaagctccgctcagttgggaaagcttacaaaattgtatcacttaaatatacacggaaagtgtgcatacaattagggacagaacaaacttgtaagcatatagatgttaatgattgcttggtcactccatcagttaaagtttgtatgattggtaccatatctaagcttcagcctggtgatactttattatttttaggccctttagagcaaggtgggattatcctcaaacaatggtgtacaacatcatgtgtatttggcgatccaggtgatatcatgtcaacgacaagcggaatgaggtgccctgaacacactgggtctttcaggaagatctgcggctttgccacaacaccaacatgtgagtatcaaggcaacacagtgtctggatttcaacgcatgatggcaacccgagattcttttcaatcgtttaatgtgacagaaccacacatcactagtaatcggcttgaatggattgatccagacagtagtattaaggaccatataaatatgattttaaaccgagatgtttcctttcaagatctaagcgacaatccatgtaaggttgatttgcatacacaatcaattgatggagcctggggatcgggagtgggtttcacgttagtgtgtactgttggtcttacagaatgtgcaaattttataacctcaatcaaagcatgtgattctgccatgtgttatggggccacagtaacaaatttgcttagggggtcaaacacggttaaagttgttggtaaaggtgggcactctgggtctttattcaaatgctgtcatgacactgattgcaccgaagaaggcttagcagcgtcaccacctcatttagatagggttacaggttataatcaaatagactctgataaagtttatgatgacggtgcaccaccctgtacaattaaatgctggtttacaaagtcaggtgagtggctattggggattcttaacggtaattgggtggtagttgctgttttaattgtgattctgatactatcaatactccttttcagcttcttttgtcctgttagaagtagaaagaataaggctaattag

SEQ ID NO: 3497 - RNA, 3423 nt, synthetic construct
  misc_feature 1..3423: note = derived and/or modified CDS sequence (wt) from SNV(2)__JQ690284.1__GP
  source 1..3423: mol_type = other RNA
atggtagggtgggtttgcatcttcctcgtggtccttactactgcaactgctgggttgacacggaatctttatgagttaaagatagaatgtccgcatactgttggtttaggccagggttatgtgacaggttcagtggaaactacacctattctcttaacacaggtagctgatctcaagattgagagttcctgtaattttgatttgcatgtcccggccactactactcaaaaatacaatcaggttgactggaccaaaaagggttctactacagaaagtacaaatgcaggtgcaaatacatttgaggctaaaacaaaggaagtaaatctgaaaggcacatgcaatattcctccaaccacatttgaggctgcatacaaatcaaggaagacagtgatctgttatgatctagcctgtaatcaaacacactgtcttccaacagtgcatttaattgctcctgttcaaacatgcatgtctgtacgaagctgtatgataggcttattgtccagtaggattcaagtcatctatgagaaaacatattgtgtcacaggtcaattaatagaagggttatgcttcattccaacacatacaattgcacttacgcagcctggtcatacttatgacactatgacactaccagtaacttgttttttagtagccaaaaagctgggaacacaactcaagttagctgttgagttagaaaaattgattactggtgtgagctgtacagaaaatagtttccaaggttattatatctgctttattgggaaacattcagagcccctattcgtgccaacaatggaggattataggtcagctgaggtatttactcgtatggttttaaatccaagaggtgaagatcatgatcctgatcagaatgggcaaggtctaatgagaatagctggacctgttactgctaaggtaccatctacagaaacaactgaaacaatgcaaggaattgcatttgctggagcacctatgtatagttcattttcaactcttgtgaggaaggctgatcctgagtatgtcttttccccgggtataattgcagaatcaaatcatagtgtttgtgataagaaaacagtacccctcacatggactggatttttggcagtctcaggagagatagaaaggataacaggctgtacagtcttttgtactttggctgggcctggtgcaagctgtgaggcatactcagagacaggaatattcaacataagctcccccacttgtttggttaataaggttcaaaaattcagaggttctgagcaaagaattaacttcatgtgccagagggttgatcaagatgtagtagtttactgtaatgggcaaaagaaagtcattctcactaagactctagttataggccaatgtatttatacattcactagtttattttcattaatcccaggagttgctcattctcttgctgtagaactatgtgttcctgggctgcatggttgggcaacaactgcattacttatcacattttgtttcggctggcttcttataccaacagttaccttaattatattaaaaatcctgaggttacttactttttcatgctcacattattctacagagtcaaagttcaaagtcatcttggaaagggtaaaggtagaatatcagaaaacaatgggctcaatggtgtgtgacatttgccatcacgaatgtgaaacagctaaagaacttgaaacacataagaagagttgcccagaaggtcagtgcccatactgcatgacaataactgagtccactgaaagtgctctacaagctcatttctcaatctgtaagttaacaaacaggtttcaggaaaatttaaaaaagtcattaaaacgcccagaagtaaagaaaggttgttacagaacactaggggtatttcggtataagagtcggtgttatgttggtctagtatgggggattcttctaacaactgagctaattatatgggcagctagcgctgacactcccttaatggagtctggttggtccgatacagcacatggagttggcataattcccatgaaaacagatttagagcttgatttcgcactagcttcatcatcttcttatagttataggagaaaacttgtaaatcctgccaatcaagaagaaacacttccttttcatttccagctagacaagcaagtggttcatgcagagatacagaatctagggcattggatggatggcacattcaatataaaaactgctttccattgttatggagaatgtaagaaatatgcttatccttggcagacagcaaagtgtttctttgaaaaggattaccagtatgagacaagttgggggtgtaacccaccagattgcccaggggtaggcacaggttgtacagcctgtggggtataccttgacaagctccgctcagttgggaaagcttacaaaattgtatcacttaaatatacacggaaagtgtgcatacaattagggacagaacaaacttgtaagcacatagatgttaatgattgcttggtcactccatcagttaaagtttgtatgattggtaccatatccaagcttcagcctggtgatactttattgtttttaggccctttagagcaaggtgggattatccttaaacaatggtgtacaacatcatgtgtgtttggcgatccaggtgatattatgtcgacaacaagcgggatgaggtgccctgaacacactgggtctttcagaaagatctgcggctttgccacaacaccaacatgtgagtatcaaggcaacacagtgtctggatttcaacgcatgatggcaactcgagattcttttcaatcgtttaatgtgacagaaccacacattactagcaatcggcttgaatggattgatccagacagtagtatcaaggaccatataaatatggttctaaaccgagatgtatcctttcaagatctaagtgacaatccatgtaaggttgatttgcacacacaatcaattgatggagcttggggatcaggagtgggttttacgttagtatgtactgttggtcttacagaatgtgcaaattttataacctctatcaaagcatgtgattctgccatgtgttatggggccacagtgacaaatttgcttagggggtcaaacactgttaaagttgttggtaaaggtggacattctgggtctttattcaaatgctgtcatgatactgattgtactgaagaaggcttagcagcatcaccacctcatttagatagggttacaggttataatcaaatagattctgataaagtttatgatgacggtgcaccgccctgtacaattaaatgctggtttacaaagtcaggtgagtggctattggggatccttaacggtaattgggtggtagttgctgttttgattgtgattctgatattatcaatactccttttcagcttcttttgtcctgttagaagtagaaagaataaagctaattag

SEQ ID NO: 3498 - RNA, 3423 nt, synthetic construct
  misc_feature 1..3423: note = derived and/or modified CDS sequence (wt) from SNV(2)__JQ690280.1__GP
  source 1..3423: mol_type = other RNA
atggtagggtgggtttgcatcttcctcgtggtccttactactgcaactgctgggttgacacggaatctttatgagttaaagatagaatgtccgcatactgtcggtttaggccagggttatgtaacaggttcagtggaaactacacctattctcttaacacaggtagctgacctcaagattgagagttcctgtaattttgatctgcatgtcccggccactactactcaaaaatacaatcaggttgactggaccaaaaagagttctactacagaaagcacaaatgcaggtgcaaatacatttgaggctaaaacaaaggaagtaaatctgaaaggcacatgcaatattcctccaactacatttgaggctgcatacaaatcaaggaaaacagtgatctgttatgatctagcctgtaatcaaacacactgtcttccaacagtgcatttaattgcccctgtccaaacatgcatgtctgtacgaagctgtatgataggcttattgtccagtaggattcaagtcatctatgagaaaacatattgtgtcacaggtcaattaatagaagggttatgcttcattccaacacacacaattgcacttacgcagcctggtcatacttatgacactatgacattgccagtaacttgttttttggtagcaaaaaaactgggaacacaactcaagttagctgtggagttagaaaaattaattactggtgtgagctgtacagaaaatagtttccaaggttattacatatgctttattgggaaacattcagagcccctatttgtgccaacaatggaggattataggtcagctgaattatttactcgtatggttttaaatccgagaggtgaagatcatgatcctgatcagaatgggcaaggtttgatgagaatagctggacctgttactgctaaggtaccatctacagaaacaactgaaacaatgcaaggaattgcatttgctggagcaccaatgtatagttcattttcaactcttgtgaggaaggctgatcctgagtatgtcttttccccgggtataattgcagaatcaaatcatagtgtctgtgataagaaaacagtacccctcacatggactggatttttggcagtctcaggagaaatagaaaggataacaggctgtacagtcttttgtactttggctggacctggcgcaagctgtgaggcatactcagagacaggaatcttcaacataagttcccccacttgtctggttaataaggttcaaaaattcagaggttcagagcaaagaatcaacttcatgtgtcagagggttgatcaagatgtagtagtttactgtaatggacaaaagaaagtcattctcactaagactctagttataggccaatgtatttatacattcaccagtttattttcactgattccaggagttgctcattctcttgctgtagaattatgtgttcctgggctgcatggttgggcaacaactgcattacttatcacattttgtttcggctggctccttataccaacagttaccttaattatattaaaaatcctgaggttgcttactttttcatgctcacattactctacagagtcaaaattcaaagtcatcttggaaagggtaaaggtggaatatcagaagacgatgggctcaatggtgtgtgacatttgccatcatgaatgtgaaacagctaaagaacttgaaacacataagaagagttgcccggaaggtcagtgcccatactgcatgacaataactgaatccactgaaagtgctctacaagctcatttctcaatatgtaagttaacaaacaggtttcaggaaaatttaaaaaagtcattaaaacgcccagaagtaaagaaaggttgttacaggacactaggggtatttcggtataagagtcggtgttatgttggtctagtatgggggattcttctaacaactgagctaattatatgggcagctagcgctgacacccccttaatggagtctggttggtctgatacagcacatggagttggcataattcccatgaaaacagatttagagcttgatttcgcactggcttcatcgtcttcttatagttatagaagaaaacttgtaaatcctgccaatcaagaagaaacacttcctttccatttccagctagacaagcaagtggttcatgcagagatacagaatctagggcattggatggatggcacattcaacataaaaactgctttccattgctatggagaatgtaaaaaatatgcttatccctggcagacagcaaagtgtttctttgaaaaggattaccagtatgagacaagttggggctgtaacccaccagattgcccaggggtaggcacaggctgtacagcctgtggggtataccttgacaagctccgctcagttgggaaagcttacaagattgtatcacttaaatatacacggaaagtgtgcatacaattagggacagaacaaacttgtaagcatatagatgttaatgattgcttggtcactccatcagttaaagtttgtatgattggtaccatatctaagcttcagcctggtgatactttattatttttaggccctttagagcagggtgggattatcctcaaacaatggtgtacaacatcatgtgtatttggcgatccaggtgatattatgtcaacgacaagcggaatgaggtgccctgaacacactgggtctttcaggaagatctgcggctttgccacaacaccaacatgtgagtatcaaggcaacacagtgtctggatttcaacgcatgatggcaacccgagattcttttcaatcgtttaatgtgacagaaccacacatcactagtaatcggcttgaatggattgatccagacagtagtattaaggaccatataaatatggttttaaaccgagatgtttcctttcaagatctaagcgataatccatgtaaggttgatttgcatacacaatcaattgacggagcttggggatcaggagtgggtttcacgttagtgtgcactgttggtcttacagaatgtgcaaattttataacctcaatcaaagcatgtgattctgccatgtgttatggggccacagtaacaaatttgcttagggggtcaaacacggttaaagttgttggtaaaggtgggcactctgggtctttattcaaatgctgtcatgatactgattgcactgaagaaggcttagcagcgtcaccacctcatttagatagggttacaggttataatcaaatagattctgataaagtttatgatgacggtgcaccaccctgtacaattaaatgctggtttacaaagtcaggtgagtggctattggggattcttaacggtaattgggtggtagttgcagttttgattgtgattctgatactatcaatactccttttcagcttcttttgtcctgttagaagtagaaagaataaggctaattag

SEQ ID NO: 3499 - RNA, 3423 nt, synthetic construct
  misc_feature 1..3423: note = derived and/or modified CDS sequence (wt) from SNV(CC107/POR)__KT885045.1__GP
  source 1..3423: mol_type = other RNA
atggtagggtgggtttgcatcttcctcgtggtccttactactgcaactgctggattgacacggaatctctatgaattaaagatagaatgtccacatactgtgggtctaggtcaaggttatgtgacaggttctgtagaaactacacctattctcttaacacaggtagctgacctcaagatcgagagttcttgcaattttgacttgcatgtcccagccactactactcagaaatacaatcaagttgactggactaaaaaaagttctactacagaaagcacgaatgcaggtgcaactacatttgaggctaaaacaaaagaggtaaatttaaaaggcacatgtaatattcctccaactacgtttgaggctgcatacaagtcaaggaagacagtgatttgttatgatttggcctgtaatcaaacacattgtcttcctacagtccatctgattgctcctgttcaaacatgtatgtctgtacggagctgtatgataggtctgttatctagcaggatccaggttatctacgagaagacatattgtgtcacgggtcagttaatagaagggctatgtttcattccaacacatacaattgcacttacacagcctggtcatacttatgatactatgacattgcctgtgacttgttttttagtagccaaaaagttggggacgcagcttaagctggctgttgagttagagaaattgattactggtgtgagctgcacagagaatagcttccaaggttattacatctgttttattggaaaacattcagagcccttatttgtaccaacaatggaagattatagatcagctgagttatttactcgtatggttttaaatccaagaggtgaagatcatgaccctgatcaaaatggacaagggttgatgagaatagctggacctgttactgccaaggtaccatctacagaaacgactgaaacaatgcaaggaattgcatttgctggggcaccaatgtatagctcattctcaactcttgtgagaaaagctgatcctgaatatgtcttttctccaggtataattgcagaatcaaatcatagtgtttgtgataaaaagacagtgcccctaacatggactgggtttctagcagtttcaggagagatagaaaggataacaggctgtacagttttctgtacattggctggacctggtgccagttgtgaagcatactcagaaacaggaatcttcaacataagctccccaacttgcttggtaaataaagtccaaaaatttagaggttcagaacaaagaattaattttatgtgtcaaagggttgatcaagatgttgtggtttactgtaatggacagaagaaagtcattcttaccaaaaccctagtaataggtcaatgtatctacacatttactagtctgttttcactgatccctggagttgctcattcccttgctgtggagttatgtgttccaggtcttcatggctgggctacaacagcactacttattactttctgctttggctggcttctcataccaacagttactttaattatactaaaaatcttaaggctattgaccttctcatgctcgcactattctacagaatcaaaattcaaagtcattttagaaagagtcaaggtggagtatcaaaagacaatgggctcaatggtgtgtgacatttgtcaccatgaatgtgagacggcaaaagagctcgaaacacataagaaaagttgcccagaaggtcaatgcccatactgcatgacaataactgagtccactgagagtgcattacaagctcatttttcaatctgtaagctaacgaacaggttccaggaaaatctaaaaaaatcattaaaacgtccagaagtaaggaaaggttgttacaggacattaggagtattccgctacaagagcaggtgctatgttggcttagtatgggggatcctcttgacgacagagctgattatatgggctgctagtgcagatacccctctaatggagtctggttggtcagatacagcacatggtgtaggtatagtccctatgaaaacagatttagagcttgactttgccttggcctcatcatcttcttatagttatagaagaaagcttgtaaaccctgccaatcaagaggagacactcccttttcatttccagttagataagcaagtagtgcatgcagagatacagaacctagggcattggatggatggcacattcaacataaagactgctttccattgctatggagaatgtaaaaaatatgcctatccttggcagacagccaagtgtttctttgaaaaagattatcagtatgaaacaagctggggctgtaacccaccagattgcccaggagtagggacaggttgtacagcctgtggggtatacttagacaagctccgttcagttgggaaagcctataaaattgtatcactcaaatacacgcgaaaggtgtgtattcaattggggacagaacaaacctgtaaacatatagatgttaatgattgtttggtcaccccgtctgttaaagtttgcatgataggtaccatctcgaagcttcagccaggtgacaccttattgtttttgggccctttagagcaaggtgggattattctaaaacaatggtgcacaacatcatgtgtgtttggagaccctggtgatatcatgtcaacaacaagtgggatgagatgccctgagcacacagggtcttttagaaaaatctgtggatttgctacaacacctacatgtgaatatcaaggtaatacagtgtctggattccaacgcatgatggcaactcgagattcttttcaatcattcaatgtgacagaaccacatattaccagcaatcgactggaatggattgatccagatagtagtattaaagaccatatcaacatggttttgaatagagatgtttccttccaagatctaagtgataatccatgtaaggttgatttgcatacacaatctattgatggggcttggggatcaggagtgggctttacattagtatgtactgtaggtcttacagagtgtgcaaatttcataacttcaattaaggcgtgtgattctgctatgtgttatggggccacagttacaaatctactcagagggtctaacacagttaaagttgtcggtaaaggtgggcattctgggtccttgttcaagtgctgccatgatactgactgtactgaagaaggtttagcagcatcaccacctcatttagatagggttactggttacaatcaaatagattctgataaggtttatgatgacggtgcaccgccctgtacaattaaatgttggttcacaaagtcaggtgagtggttgctaggaattcttaatggcaattgggtagtagttgctgttttgattgtaattttgatactatcaatactcctgttcagcttcttttgtcctgttagaaatagaaaaaataaggccaattag

SEQ ID NO: 3500 - RNA, 3423 nt, synthetic construct
  misc_feature 1..3423: note = derived and/or modified CDS sequence (wt) from HPS(Convict Creek 107)__L33474.1__GP
  source 1..3423: mol_type = other RNA
atggtagggtgggtttgcatcttcctcgtggtccttactactgcaactgctggattgacacggaatctctatgaattaaagatagaatgtccacatactgtgggtctaggtcaaggttatgtgacaggttctgtagaaactacacctattctcttaacacaggtagctgacctcaagatcgagagttcttgcaattttgacttgcatgtcccagccactactactcagaaatacaatcaagttgactggactaaaaaaagttctactacagaaagcacgaatgcaggtgcaactacatttgaggctaaaacaaaagaggtaaatttaaaaggcacatgtaatattcctccaactacgtttgaggctgcatacaagtcaaggaagacagtgatttgttatgatttggcctgtaatcaaacacattgtcttcctacagtccatctgattgctcctgttcaaacatgtatgtctgtacggagctgtatgataggtctgttatctagcaggatccaggttatctacgagaagacatattgtgtcacgggtcagttaatagaagggctatgtttcattccaacacatacaattgcacttacacagcctggtcatacttatgatactatgacattgcctgtgacttgttttttagtagccaaaaagttggggacgcagcttaagctggctgttgagttagagaaattgattactggtgtgagctgcacagagaatagcttccaaggttattacatctgttttattggaaaacattcagagcccttatttgtaccaacaatggaagattatagatcagctgagttatttactcgtatggttttaaatccaagaggtgaagatcatgaccctgatcaaaatggacaagggttgatgagaatagctggacctgttactgccaaggtaccatctacagaaacgactgaaacaatgcaaggaattgcatttgctggggcaccaatgtatagttcattctcaactcttgtgagaaaagctgatcctgaatatgtcttttctccaggtataattgcagaatcaaatcatagtgtttgtgataaaaagacagtgcccctaacatggactgggtttctagcagtttcaggagagatagaaaggataacaggctgtacagttttctgtacattggctggacctggtgccagttgtgaagcatactcagaaacaggaatcttcaacataagctccccaacttgcttggtaaataaagtccaaaaatttagaggttcagaacaaagaattaattttatgtgtcaaagggttgatcaagatgttgtggtttactgtaatggacagaagaaagtcattcttaccaaaaccctagtaataggtcaatgtatctacacatttactagtctgttttcactgatccctggagttgctcattcccttgctgtggagttatgtgttccaggtcttcatggctgggctacaacagcactgcttattactttctgctttggctggcttctcataccaacagttactttaattatactaaaaatcttaaggctattgaccttctcatgctcgcactattctacagaatcaaaattcaaagtcattttagaaagagtcaaggtggagtatcaaaagacaatgggctcaatggtgtgtgacatttgtcaccatgaatgtgagacggcaaaagagctcgaaacacataagaaaagttgcccagaaggtcaatgcccatactgcatgacaataactgagtccactgagagtgcattacaagctcatttttcaatctgtaagctaacgaacaggttccaggaaatcttaaaaaagtcattaaaacgtccagaagtaaggaaaggttgttacaggacattaggagtattccgctacaagagcaggtgctatgttggcttagtatgggggatcctcttgacgacagagctgattatatgggctgctagtgcagatacccctctaatggagtcaggttggtcagatacagcacatggtgtaggtatagtccctatgaaaacagatttagagcttgactttgccttggcctcatcatcttcttatagttatagaagaaagcttgtaaaccctgccaatcaagaggagacactcccttttcatttccagttagataagcaagtagtgcatgcagagatacagaacctagggcattggatggatggcacattcaacataaagactgctttccattgctatggagaatgtaaaaaatatgcctatccttggcagacagccaagtgtttctttgaaaaagattatcagtatgaaacaagctggggctgtaacccaccagattgcccaggagtagggacaggttgtacagcctgtggggtatacttagacaagctccgttcagttgggaaagcctataaaattgtatcactcaaatacacgcgaaaggtgtgtattcaattggggacagaacaaacctgtaaacatatagatgttaatgattgtttggtcaccccgtctgttaaagtttgcatgataggtaccatctcgaagcttcagccaggtgacaccttattgtttttgggccctttagagcaaggtgggattattctaaaacaatggtgcacaacatcatgtgtgtttggagaccctggtgatatcatgtcaacaacaagtgggatgagatgccctgagcacacagggtcttttagaaaaatctgtggatttgctacaacacctacatgtgaatatcaaggtaatacagtgtctggattccaacgcatgatggcaactcgagattcttttcaatcattcaatgtgacagaaccacatattaccagcaatcgactggaatggattgatccagatagtagtattaaagaccatatcaacatggttttgaatagagatgtttccttccaagatctaagtgataatccatgtaaggttgatttgcatacacaatctattgatggggcttggggatcaggagtgggctttacattagtatgtactgtaggtcttacagagtgtgcaaatttcataacttcaattaaggcgtgtgattctgctatgtgttatggggccacagttacaaatctactcagagggtctaacacagttaaagttgtcggtaaaggtgggcattctgggtccttgttcaagtgctgccatgatactgactgtactgaagaaggtttagcagcatcaccacctcatttagatagggttactggttacaatcaaatagattctgataaggtttatgatgacggtgcaccgccctgtacaattaaatgttggttcacaaggtcaggtgagtggttgctaggaattcttaatggcaattgggtagtagttgctgttttgattgtaattttgatactatcaatactcctgttcagcttcttttgtcctgttagaaatagaaaaaataaggccaattag

SEQ ID NO: 3501 - RNA, 3423 nt, synthetic construct
  misc_feature 1..3423: note = derived and/or modified CDS sequence (wt) from HPS(Convict Creek 74)__L33684.1__GP
  source 1..3423: mol_type = other RNA
atggtagggtgggtttgcatcttcctcgtggtccttactactgcaactgctggattgacacggaatctctatgaattaaagatagaatgtccacatactgtgggtctaggtcaaggttatgtgacaggttctgtagaaactacacctattctcttaacacaggtagctgacctcaagatcgagagttcttgcaattttgacttgcatgtcccagccactactactcagaaatataatcaagttgattggaccaaaaaaagttctactacagaaagcacaaatgcaggtgcaactacatttgaggctaaaacaaaagaggtaaatttaaaaggcacatgtaatattcccccaactacgtttgaggctgcattcaagtcaaggaagacagtgatttgttatgatttggcctgtaatcaaacacattgtcttcctacagtccatctgattgctcctgttcaaacatgtatgtctgtacggagctgtatgataggtctgttatctagcaggatccaagtcatctacgagaagacatattgtgtcacgggtcagttaatagaagggctatgtttcattccaacacatacaattgcacttacacagcctggtcatacctatgatactatgacattgcctgtgacttgttttttagtagccaaaaagttggggacacagcttaagctggctgttgagttagagaaattgattactggtgtgagctgcacagagaatagcttccaaggttattacatctgttttattggaaaacattcagagcccttatttgtaccaacaatggaagattatagatcagctgagttatttactcgtatggttttaaatccaagaggtgaagatcatgaccctgatcaaaatggacaagggttgatgagaatagctggacctgttactgccaaggtaccatccacagaaacaactgaaacaatgcaaggaattgcatttgctggggcaccaatgtatagctcattctcaactcttgtgagaaaagctgatcctgaatatgtcttttctccaggtataattgcagaatcaaatcatagtgtttgtgataaaaagacagtgcccctaacatggactgggtttctagcagtttcaggagagatagaaaggataacaggctgtacagttttctgtacattggctggacctggcgccagttgtgaagcatactcagaaacaggaatcttcaacataagctccccaacttgcttggtaaataaagtccaaaaatttagaggttcagaacaaagaattaattttatgtgtcaaagggttgatcaagatgttgtggtttactgtaatggacagaagaaagtcattctcaccaaaaccctagtaataggtcaatgtatctacacatttactagtctgttttcactgatccctggagttgctcattcccttgctgtggagttgtgtgttccaggtcttcatggctgggctacaacagcactacttattactttctgttttggctggcttctcataccaacagttactttaattatactaaaaatcttaaggctattgactttctcgtgctcgcactattctacagaatcaaaattcaaagtcattttagaaagagtcaaagtggagtatcaaaagacaatgggctcaatggtgtgtgacatttgtcaccatgaatgtgagacagcaaaagagctcgaaacacataagaaaagttgtccagaaggtcaatgcccatactgcatgacaataactgagtccactgagagtgcgttacaagctcatttttcaatctgtaagctaacgaacaggttccaggaaatcttaaaaaaatcattaaaacgtccagaagtacggaaaggttgttacaggacattaggagtattccgctacaagagcaggtgctatgttggcttagtatgggggatcctcttgacgacagagctgattatatgggctgctagtgcagatacccctctaatggagtctggttggtcagatacagcacatggtgtaggtatagtccctatgaaaacagatttagagcttgactttgccttggcctcatcatcttcttatagttatagaagaaagcttgtaaaccctgccaatcaagaggagacactcccttttcatttccagttagataagcaagtagtgcatgcagagatacagaacctggggcattggatggatggcacattcaacataaagactgcttttcattgctatggagaatgtaaaaaatatgcctatccttggcagacagccaagtgtttctttgaaaaggattatcagtatgaaacaagctggggctgtaacccaccagattgcccaggagtagggacaggttgtacagcctgtggggtatacctagacaagctccgttcagttgggaaagcctataagattgtatcactcaaatacacgcgaaaggtgtgtattcaattgggaacagaacaaacctgtaaacacatagatgttaatgattgtttagtcaccccgtctgttaaagtttgcatgataggtaccatctcaaagctccagccaggtgacaccttattgtttttgggccctttagagcaaggtgggattatcctgaaacaatggtgcacaacatcatgtgtatttggagaccctggtgatatcatgtcaacaacaagtgggatgagatgccctgagcacactgggtcttttagaaaaatctgtggatttgctacaacacctacatgtgaatatcaaggtaatacagtgtctggattccaacgcatgatggcaactcgagattcttttcaatcattcaatgtgacagaaccacatattaccagcaatcgactggaatggattgatccagatagtagtattaaagaccatatcaacatggttttgaatagagatgtttccttccaagatctaagtgataatccatgtaaggttgatttgcatacgcaatctattgatggggcttggggatcaggagtgggcttcacattagtatgtactgtaggtcttacagagtgtgcaaatttcataacttcaattaaggcatgtgattctgctatgtgttatggggccacagttacaaatctactcagagggtctaacacagttaaagttgtcggtaaaggtgggcattctgggtccttgtttaagtgctgccatgatactgattgtactgaagaaggtttagcagcatcaccacctcatttagatagggttactggttacaatcaaatagattctgataaggtttatgatgacggtgcaccgccctgtacaattaaatgttggttcacaaagtcaggtgagtggttgctaggaattcttaatggcaattgggtagtagttgctgttttgattgtaattttgatactatcaatactcctgttcagtttcttttgtcctgttagaaatagaaagaataaggccaattag

SEQ ID NO: 3502 - RNA, 3423 nt, synthetic construct
  misc_feature 1..3423: note = derived and/or modified CDS sequence (wt) from BRV(Indiana)__AF030551.1__GP
  source 1..3423: mol_type = other RNA
atggtagggtgggtttgcatcttccttgtggttcttactactgccacggctgggttaacacggaatctttatgagttaaagatagaatgcccacatactgtgggtttaggccaaggttatgttacaggatcagttgaaacaacaccagttcctttagggcaggtgactgatttaaagattgagagctcttgtaactttgatttgcatgtaccgtcaacaacaattcagaagtacaatcaagtggaatgggcaaagaaaacatctacaacagaaagtactaatgcaggtgcatctacatttgaagcaaagacaaaggaagtaaatctgaagggcacatgcaacattccagtaactacgtttgaggctgcttataagtcaagaaagacagtcatttgctatgacctagcatgtaatcagacccattgccttcccacagtccatttaattgcccctgtccagacatgcatgtctgttcgaagttgtatgatagggcttttatctagtagaattcatgtgatatatgaaaaaacatattgtgtcaccggacaagtagtggaagggttatgtttcattcccacacacacaattgcattgacacaaccaggacatacatacgatacaatgaccttgccaataacttgttttttagtggcaaagaaattagggacacaattaaagattgctgtagagcttgagaagttgatcactgcaagtggctgtactgaaaatagttttcaaggttattatatttgcttcttggggaaacactctgagcctttgtatgtaccgactatggatgattacagatcagctgaactatttacaaggatggttctaaaccccaaaggtgaggatcatgatcctgatcaggatgggcagggactgatgaggattaccggacctattactgctaaggtgccttcaacagagacaactgaaacaatgcaaggggtagcatttgctggaacaccaatgtatagttctttctcaacactactaagaaaggctgaccctgagtatgtgttttctccagggataattcctgagtcaaatcacagtgtttgtgataagaagacaatgcctatcacctggacgggatttcttgcagtatctggagaaattgagaagataacaggttgtacagtcttttgcacacttgctggaccaggtgcaagttgtgaagcctactcagaaactggcatatttaatattagctcacctacatgtctggtcaacaaagtgcaaaaatttaggggatcagaacaacgagtaaattttatgtgtcagagagttgaccaagatgtagtagtatactgcaatgggcaaaagaaagtgatcctcacaaaaacattggtcataggacaatgtatttatacattcaccagtctcttctccttgcttccaggtgtggcccattcacttgccgttgaattatgtgtaccagggcttcatggctgggcaacgactgctttactcatcacattctgttttggatggctgcttataccctcggtaacattaataatattaagaatcttacggctcctcacattttcttgctcacactactcaacagagtcaaaatttaagatactcttggagaaggtaaaagtggagtatcaaaaaacaatgggttcaatggtctgtgatatttgccatcatgagtgtgaaaccgccaaagaactcgatacacacagaaaaagctgtcctgaaggtcaatgtccttactgcatgacaatgactgagtcaacagagagtgcacttcaggcccacttttcagtctgcaagctcacaaataggttccaggaaaatttaaaaaagtctttaaagcatccagaagtgaaacaaggctgttataggacattaggggttttcagatataaaagcaggtgttacgtaggattagtttggggtatactcttaacagctgaattgataatctgggcagcaagtgcagaaactccattgatggaatcaggttggtcagatacagcacatggagttggtatagttcctatgaaaactgatttggagctagattttgcattggcatcatcctcctcatacagctatagaaggaagcttgtgaatcctgcaaattcagaagagacactgccattccaccttcaattggagaaacaagttgttcatgctgaaatccacaatttggggcattggatggatggtacatttaacatcaagactgcatttcattgttatggggaatgtaagaaatatgcttacccttggcagacagcaaaatgtttctttgaaaaagattatcagtatgaaacaagttggggctgtaatccacctgactgcccaggggtagggacaggatggacagcttgtggagtttaccttgataagctaagatcagttgggaaggcatataaaattgtctccttaaaatataccaggaaagtctgcatccaactaggcacagaacagacatgcaagcatattgatgtgaatgattgtcttgttactccatcagtgaaggtatgtatgattggtactgtatcaaagttacagcctggtgatacattgttgttcctgggtccattggagcaaggaggtatcattctaaaacagtggtgcacaacatcatgtgtttttggggacccaggggacataatgtccacaaccagtggaatgaaatgtcctgaacatacagggtcatttagaaaaatctgtggatttgcaacaacaccaacttgtgagtatcaagggaacacagtttcagggtttaagaggatgatggccacgagggattcttttcaatcatttaatgtgacagaaccgcatatcaccagtaaccgattagaatggattgaccctgacagtagtatcaaagatcatataaatgtagtgttaaatcgtgatgtgtcctttcaagatttgagtgataacccttgtaaagtagacttacacacacagtctatagatggtgcatggggttctggagtgggcttcactttagtgtgtacagtaggcttgacagaatgcgcaaactttatcacatcaatcaaggcctgtgacttagcaatgtgttatggagcaacagtgacaaacttactgaggggttcaaatacagttaaggttgttgggaagggtgggcattcaggttcactattcaaatgttgtcatgatactgactgtactgatgaagggcttgctgcctctccaccacatcttgaccgagtcactggattcaatcaaatagattctgacaaagtttatgatgatggtgctccaccatgttccgtcaaatgttggtttacgaaatctggagagtggctgcttagaatactgaatggcaattggatggtggtggctgtgctgattgttatcctaatactgtctattctactattcagctttttttgccccattcgaagtagaaagagcaaacccaattag

SEQ ID NO: 3503 - RNA, 3423 nt, synthetic construct
  misc_feature 1..3423: note = derived and/or modified CDS sequence (wt) from BRV(Oklahoma)__AF030552.1__GP
  source 1..3423: mol_type = other RNA
atggtagggtgggtttgcatcttcctcgtggtccttactacttccacggctggattaacacggaatctttatgagttgaagatagaatgcccgcatacagtagggttaggtcaaggttatgtgacagggtcggttgagataacacctgttcctttagggcaggtgactgatttaaagattgaaagttcctgtaattttgatttacatgtgccgtcaacaacaatccaaaagtatactcaagttgagtgggcaaaaaaaagttcaactacagaaagcaccaatgcagctgctactacattcgaggccaagacaaaggaggtgagtttaaagggcacatgcaatattccagtgacaacatttgaagctgcttataagtcaaggaagacagtcatatgttatgatttagcatgtaatcaaactcactgtctacctacagttcatctcattgctcctgtacaaacatgtatgtctgttcgaagttgtatggtaggattgctgtctagtaggatacaagtaatttatgaaaaaacatactgtgttaccggtcaattggtagagggattgtgttttatacctactcatacaatagcactgacacaaccagggcatacatatgacacaatgaccttacctattacctgctttcttgtagcaaagaaattaggaacacagttaaaaatagctgtagagcttgaaaagttaatcactgccagcgggtgtactgaaaatagctttcaaggttactatatctgttttttaggaaagcattctgaacctatgtatgtaccaacaatggatgattatagatcagctgagctattcacaaggatggttttaaaccctaaaggtgaagatcatgaccctgatcaaaatgggcagggattaatgagaattgctggacccattacagccaaagttccgtcaacagagacaacagagactatgcaaggaatagcatttgctggagcaccaatgtatagcacttttgcaaccttagtaaggaaagcagatcctgagtatgtgttttcaccaggcataatccctgaatcaaatcatagtgtctgtgacaaaaagacaatgcctatcacatggactggctttcttgcactttctggagaaatagaaaggataacaggatgtacagttttttgtacacttgcaggacctggtgcaagttgtgaagcatattcagaaactggcatatttaatattagctcaccaacttgcctagtcaataaagtacaaaagtttaggggttcagagcaaagaattaattttatgtgccaaagagttgatcaagatgtggttgtatattgcaatggacagaagaaggtaattctcactaaaaccctagtcataggacagtgtatttatacattcactagtcttttctccctgcttcctggtgtggcccattcccttgctgttgaactatgtgtgcctggcctccatggttgggctacaacagctttactcatcacattttgctttggctggttgctcatacctgcaatcacattgattgtgctgaaaattttaagactgctcacattttcatgttcacattactcaaaagagtctagatttaaaatactcttagaaaaggtgaaggttgaataccaaaagacaatgggttcaatggtttgtgacatttgtcatcatgattgtgagacagctaaagagcttgatacacacaaaaagagttgtccagagggtcaatgcccttactgtatgaccatgactgaatcaacagaaagtgctctccaggcccatttttcagtctgcaaacttacaaatagatttcaagaaaatttaaaaaaatccttaaagcacccagaagtaaaacagggctgttataggacattaggagtatttaggtataaaagtagatgttatgtaggccttgtgtggggtttgcttctgacaactgaacttatcatctgggcagctagtgcagaaactccattgatggagtcagggtggtctgatacagcacatggtgtaggtatagtccctatgagaacagatctagaacttgattttgcattagcatcatcatcctcatacagctatagaaggaagctcgtaaaccctgccaatacagaggaaactttacctttccatcttcaattggaaaaacaggttgttcatgccgaaatacaaaatctggggcattggatggatgggacattcaatatcaaaactgcatttcactgttatggagaatgtaaaaaatatgcctacccttggcagactgccaagtgtttttttgaaaaagattatcaatatgagacaagttggggttgtaacccacctgattgcccaggggtagggacaggatgtacagcatgtggggtttatcttgataagttgcgatcagttgggaaggcatataagattgtttctttaaaatacacaagaaaggtttgcatccaattgggcacggaacaaacgtgcaaacatattgatgttaatgattgtcttgtttctccatcagtaaaagtttgcatgattggcactgtctcaaaactacagcctggtgacacactactgtttttaggtccacttgaacaaggtggtattatactaaagcagtggtgtacaacatcatgtgtgtttggagatcctggagacataatgtcaacaacgagtgggatgagatgtcctgagcatacaggttcatttagaaagatctgtggttttgcaacaacaccgacttgcgaatatcagggcaatacaatttcaggatttaaaagaatgatggccacaagagattctttccagtcattcaatgttacagaacctcatataactagtaaccgactagaatggattgaccctgacagtagtattaaagaccatataaatgtagtgctaaatcgtgatgtgtcttttcaagatttaagtgataatccctacaaagtagatttgcacacacaatctatagacggtgcatggggttctggggtaggttttactctagtatgtattgtgggtcttacagagtgtgcaaattttatcacttcaatcaaggcatgtgatatggcaatgtgttatggggcaactgtgacaaacttattgaggggttctaacacagtcaaagttgtgggcaaaggtgggcattcaggctcattattcaagtgctgccatgatactgactgtactgaagaaggtcttgctgcctccccaccacatctagatcgggttactggttacaatcaaatagactcagataaagtttgtgatgatggtgctccactatgttcagttaagtgttggttcactaagtctggagaatggctgcttgggatattaaatggcaattggatggtagtggctgtcttggttgtgatactgatactttcaatattacttttcagctttttctgcccaatccggagtaaaaagagtaagcccaattaa

SEQ ID NO: 3504 - RNA, 3399 nt, synthetic construct
  misc_feature 1..3399: note = derived and/or modified CDS sequence (wt) from THAIV(Thai749)__L08756.1__GP
  source 1..3399: mol_type = other RNA
atgtggggtttactagttattgctgttttagttggcccaggttttgcaataaagaatgtatatgatatgaagatagagtgtccacattcagttaacttcggagaaaccagtgttacaggtcaagtcgaattgccagcacttccaatcacagaggcagaacagcttgtcccagaaagttcctgcaacatggataaccaccaatctcttgccactatcaacactctgacaaaggttagttggaggaaaaaggctgatcaggtctcagctagtcaaaactcctttgaagtgatcgaagcagagactagttttaaaggattgtgtatgcttaagcacaggatgattgaagaatcatttaaaaatagaaggtcagttatctgttatgatctatcttgtaatacgactttttgtaaaccaacagtttatatggttgtccccgtgcatgcttgcaacatgatgaaaagctgtcttgtcggtttgggaccatacagagttcaagttgtttatgagaggacctattgtactgttgggatactgacagaagggaaatgttttattccagataagacgattttaagttcaattaagagggggatgtttgttgtcactagtgtgcaagtgctttgtttttttattgtccagaaaggtcatagttataaaataatggatgaggttaaaaaatcaatgatgaataaatgcaatgatactgaaaacaaagttcaaggctattacatctgtatattaggcgggaactcagcaccagtctatgtgccatctctagatgactttaggtctatggaaattttctcaaatatgctccgatctccttttggtgaagatcatgaccttccaggtgaggaattttcaacatatcagattgcaggtcctactgaagcaaaagtccctcacactgccagctccaaaaacctggcattgattgcttattcagggaacccatcatattcttctttaagccttataacctcttcacaggatggaagatatgtatttagtccaggacttttccctaacttaaaccagacacagtgtgaaaaaaatgcattaccaatggtatggagagggatgattgacctttctgggtactatgaggctatccacccgtgtaatatcttctgtgtcttatctggtccaggtgcatcatgtgaagccttttcagagggtggaatattcaatatcacctcaccaacatgtcttgtttcaaaacaaaatagatttcgagcagcagaacaacaaataaactttgtgtgtcagcgtgttgacatggatattgttgtgtactgtaatggccaaaaaaagaccatcttgactaaaacacttataatcgggcaatgcatttatacaataacaagcctattttcactcttgcctggtgttgcacactcaattgctatcgaattatgtgtacctggatttcatggctgggcaactgcagcactattgattaccttttgctttggctggatactcatcccaacgataactttggctgtattggtagtccttaaattcattgcaaatattctccacacaaattcccaagaaaataggtttaaacttatcctaaagaaagtgaaggaggaattcgaaaagacaaaagggtctatggtttgtgaagtctgtaaatatgagtgtgagacctcaaaagaactcaaagcacataacctatcatgcccacaatctaaatgcccttactgtttcacacattgtgagcccacagaagcaacatttaaggcacattacaaagtatgtcaagcaacacatcgattccgggaagatttaaaaaagacagtaacacctcaaactgttggccctggatgttataggacgttgaacctatttaggtataaaagcagatgttacatactgacaatgtggcttttcctcctttcaattgaatccataatgtgggctgcaagtgcagctgaaatcccacttgtcccactctggacagataatgcacatggcattggatcagtcccaatgcatactgacttagaacttgatttttccttaccttcaagctcaaaatacacatataaaagaaaactcactaacccagttaacacagaacaaggagttcaattacatatagagattgaagagcaaggaattggtgcagatgtccatcacctaggccattggtttgatgcccggcttaatttaaaaacatcattccattgttacggggcatgctcaaagtaccagtacccttggcatacagccaagtgtcactttgaaaaagattatgaatatgaaaatagttgggcctgtaacccagctgattgccctggtgtgggtactgggtgtaccgcttgcgggctgtaccttgatcaaatgaagccaataggaactgcttataaacttgttgctatcaggtatagtagaaaagcatgtgtccaatttggagaagaacatttatgcaagacaattgacatgaatgattgtttcgtaactcgccatgtcaaaatatgtatcattggtactgtgtctaaatttatacaaggggatacattacttttcctaggcccacttgaaggtggtggtttaatatttaaacattggtgcacatcaacctgtcaatttggtgatccaggggatattatgagtccaaaagataaacctttcctctgcccagaattcccaggtcagttccggaaaaagtgtaattttgcaacaaccccagtatgtgaatatgatggtaatcaaatctctggctataaaaagatgaaagcaaccattgattcttttcaatctttcaacaccagcagcattcattttacagatgaaagattgatggaagaccctgatggcatgttacgtgatcatataaatatagttgttacaaaggatatagattttgaaaatttggctgagaatctgtgcgggataggacttcaagtttcagcaattaaaggagcatggggttctggagttggattcacattaacttgccaagtatctttgactgagtgtcctacatttttaacatcaattaaggcatgtgacatggcaatatgctatggtgcagaaagtgtcactcttgttagaggacaaaatacagtaaaaatcagtgggaaaggtggacacagtggttcatcatttaagtgttgccatggagttgattgttcaagcaacggcttgcaagcaaacccaccccatcttgacagggttgcaggagtcagcgagttaactaatgaaaaagtatatgatgatggggcaccccaatgtggaatcgcttgctggttcataaagtctggagaatgggtgaagggcatctttagtggtaattggatcgtcttgattgtcttatgtgtgttacttttaatatccttaatccttcttggtatcttctgtcctgtccgtaagcataaaaagtcataa

SEQ ID NO: 3505 - RNA, 3426 nt, synthetic construct
  misc_feature 1..3426: note = derived and/or modified CDS sequence (wt) from TULV(Moravia/5302v/95)__NC_005228.1__GP
  source 1..3426: mol_type = other RNA
atgttttgtctgtgtttgagtcttctcggtctactactatgttggccagcagctacaagaaaccttttagaactgaaggttgaatgtccacacacaattgggttaggacaaggtattgtgattggtagtgcagaattgccacctgtgcctttagcgaaggtagagtcactgaagctggaaagttcttgtaactttgacttgcatacaagcacagctgcacaacaggcttttactaaatggtcatgggagaagaaggctgatactgctgagaatgcaaaagcagcatcaacaacatttcaatctagcagtaaggaagtgcaattaagaggtctttgtgtcataccaacccttgtccttgagactgcttctcggacaaggaaaactgtcacatgttttgacctttcatgtaatcagactgtatgtcaacccacagtgtatttaatggcaccaatccagacctgtgttaccacaaaaagctgcttgttaggtttaggggatcagaggattcaagtagtttatgaaaagacatattgtgtgtcaggacaattaattgaagggaattgctttaacccgctgcacactattgctatatctcaaccaactcatacctatgatattatgacactagctgtgcattgcttttttatttcaaaaaaaggtggtacagatgacacgttaaagattgaaaagcagtttgaaaccctagttgagaaaacaggttgtacagagaatgcacttaaaggttattatgcatgtattttaggcacaagttctgaagtggtatatgttcctgcaatggatgattataggtcatcagagatattgtctaggatgaccacagcaccccatggagaagaccatgacatagaccctaatgccattagctcactgaggattgtaggacaacttactggtaaggcaccttctactgagtcttcagacactgtacaagggatagcatttgcaggaacaccactatatacttctacttcaatacttgtgcgaaaagaggacccaatttatttatggtcacctggtatcattcctgaaggtaatcattcacaatgcgataagaagaccctcccacttacatggacaggctttataactctaccaggagagattgagaaaacaactcagtgcacagtcttctgtacattatctggcccgggggcagactgtgaagcctattcagatacaggtatcttcaacataagttcacctacgtgcttagttaatagagtacagaggtttaggggggcagagcagcaggtaaagtttgtttgtcaaagggttgatttagacattactgtatattgtaatggtgtaaaaaaagtgatattaacaaaaaccttagtaataggacaatgtatatacacatttactagtatattttcattgatgccaggtgttgcacattctcttgcagttgaattatgtgttcctgggctgcatggatgggcaactatctctttattgattacattttgctttggctggctagctattcctctattatctatgattattataaggtttctattaattttcacttacttatgctcaaaatatagtactgattctaaatttaaacttataattgaaaaggtgaaacaggaataccagaaaacaatgggttctatggtttgtgaagtttgtcaacaaggatgtgagactgcaaaggagctagaatctcacaaaaaaagctgtccacatggacagtgtccatactgtctcaacccaactgaagctactgagtctgccctacaggctcattttaaagtctgtaagttgacaactaggtttcaagagaatttaaagaaatcattaagtacatatgagcctaaacgtggcctctatcgaacactctccatgtttagatacaaaagcaaatgctatgtgggtttggtttggtgtattttgttaactatggagttgatagtgtgggcagctagtgctgagacaataaatcttgaacctggatggacagacacagcccatggctcagggataatcccacttaagactgatttagaattggatttttccctaccatcttctgcaacatacacatatagaagagaactacaaaatcctgcaaatgaacaagaaaagataccattccattttcaaatggagagacaagttatacatgctgaaatacagcatttaggtcactggatggatggcacttttaatttgaaaactgcgtttcattgctatggctcttgtataaaatatgcttatccttggcagacagcaaagtgttttcttgagaaggattttgaatttgaaactggatggggctgtaatcctcctgactgcccaggggtaggtacagggtgtacagcctgtggtgtttatctagataaattacgatctgttggcaaagtttataaaatcctgtcccttaaatatactagaaaagtttgtatccagttaggtactgagcaaacatgtaagacaattgattctaatgattgtttggtaacaacttctgtgaaggtctgtatgattggaacaatatcaaaatttcaacctggagacacattattattcttagggccgctagaagagggtggaatgatttttaaacaatggtgtacaacaacatgccaatttggagacccaggtgatatcatgagcacacccttagggatgaaatgcccagaacatgcaggttcctttagaaaaaagtgttcttttgccacattgccatcatgtcagtatgatggaaacactgtatctggatatcagagaatgattgccacaaaagattcattccagtcattcaatattacagaaccccatattacaacaaattcactagaatgggttgacccagatagttctctaaaggaccatgtcaatctgatagtaaaccgggatctatctttccaagatttagctgaaaatccatgtcaggttgatttaagtgtatcatcaattgatggcgcatggggctcaggtgtggggtttaatttagtctgctctgtcagccttacagaatgtgcatcgtttctcacatcaatcaaagcatgtgattctgccatgtgttatggttcaagcacagctaatctagtaaggggccaaaacacagtacatgttgtaggcaaaggtggccattctggatccaaattcatgtgctgccatgataaaaaatgttcagctacagggcttgttgcagcagcaccacaccttgatagagtcacaggatacaatcaaattgacacaaataaggtttttgatgatggtgcaccacaatgtggtgttcattgttggttcaagaagtcaggtgaatggttgctaggtattttaagtggtaactggatggttgttgctgttcttattgcactgtttatattttcactattattattcagcctttgctgcccacgtcgtcagaattataagaaaaataaataa

SEQ ID NO: 3506 - RNA, 5055 nt, synthetic construct
  misc_feature 1..5055: note = derived and/or modified CDS sequence (wt) from CCHFV(10200)__U39455.2__GP
  source 1..5055: mol_type = other RNA
atgcatatatcattaatgtatgcaatcctttgcctacagctgtgtggtctgggagagactcatggatcacacaatgaaactagacacaataaaacagacaccatgacaacacacggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggcttcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctttagaagattgctttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 3507 - RNA, 5055 nt, synthetic construct
  misc_feature 1..5055: note = derived and/or modified CDS sequence (wt) from CCHFV(IbAr10200)__AF467768.2__GP
  source 1..5055: mol_type = other RNA
atgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggattcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctag

SEQ ID NO: 3508 - RNA, 5067 nt, synthetic construct
  misc_feature 1..5067: note = derived and/or modified CDS sequence (wt) from CCHFV(Turkey-Kelkit06)__GQ337054.1__GP
  source 1..5067: mol_type = other RNA
atgcccaccaacattatgcatacaccattagtgtgcttcattctttacctacagctgttgtgtctaggaggagctcatgggcagttaaacgcaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacctcacccccaaacaccacccagggcctgtcctcgccagagaccacatcagaacgccctgcaacaacctccatcagcacgtcaagcacagacagcacgaaccccaccacacagatgaccgacaacacccccacaccaacagtcagcacaagcccatccagcagccccagcacgccatccacaccacaaggcatacatcatcctgcaaggagtctgttgtcagtctcgagccccaagacagtaacaacaccaacaccaacgagccctggagagatgagctcggaaaccagcagtcagcactcagccatgagcagaataccaaccccccacacagcaacccgggtctccactgagatcaccaaccaccgcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagcttctgcacctcaccttagaacaggacaccgaaggcctgctagaatggtgtaagggaaaccttgggtcaaactgtgatgatgacttctttcaaaagagaatagaagaattcttcatgactggtgagtgctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacaagtctgaaaaccatcaactgtataaacctaagagcatcagtcttcaaagaacacagagaagttgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaattccttggattgtcagaaagctattgcaggtgtcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgaaagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgctgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggtgggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaa

SEQ ID NO: 3509 - RNA, 5103 nt, synthetic construct
  misc_feature 1..5103: note = derived and/or modified CDS sequence (wt) from CCHFV(UCCR4416)__KY484026.1__GP
  source 1..5103: mol_type = other RNA
atgtttctccacttcaaatttatgttgttgactaacttcttcttttgtcaactcctatggggtggcggcggggttgccagtggaggcaggaccaataccagctcaacacaaaccaccctaatatcttcaaacactttaaatagtacaatgtctgtgctggagtcatcaataggaactgccacagaaacagtgccgagcacgaccaccaacacaccggacacacaggtcaccacagacagtggttctggtgaatccagcacagacccccagaccaccagcaaagaagtaccttccacttctgtcgctaccatcaaaacacaagagtcagaaacgcacagggctcaaaacccaagtaccacggctggctcaggtgcatccactccaagcaacaccacatcaaacaaaccagatgtcaactcactcacatcaccaatcttggaggcaaagtcatcacccagccctagtaaaacatcgatgccgcaaactgcacatcatctctccagaagtcttctctcagcagcaactacagaaacaaatcaagcagcatcagtaatgaccacaaccagagagacaacaaccatgagcagtccaacaacagtcaaaaacagtgtaacagccataccaacccaaggcatcaccaccagcaacacttcgaaacagactgacactataaccctggagatctcccctaagattcaaacaacacagagtcaacagactgcaacaccagcaatcgcacctgccaccactgctattgcattcataagccctacaaacagatctaaaagggaatccaaggtgcaaataattctgactttctctcaaggcctcaagaaatattatagcaagatactgaaactcctacatctgacgcaagaagaagattctgaaggtctgcttgaatggtgtacgcgggtacttgaacaggcatgcaatgacgactacttcaatgaaagaatagaagaatttttcataaccggaaaaggctacttcaatgatgttttgcagtttaggctgtatgacacacttagtactaccgaatcaacccagaatacttcacccacagccaagcctttcaggtcatactatgccaaagggtctctaacctttgactcaggctatttctctgctaaatgttatccaagggcatcgaactcaggattgcagctaattaatgtcacacaacattcagtgaaaatagctaacacaccaggccctaaaatatctaatcctaagactatcaactgtataaacttgaaagtgtcaactgacaaggatcatagcaagcttgagatcaacgtacttctaccacaagttgctgttaatctttcaaactgccatgttttaattgaatcacatgtctgtgattactctttggacactgatgggacaataaagctcccgaaaattacacataatggggcttttataccaggtacttacaaaattgtgatagataagaaaaacaaattgaatgataggtgtgcactattcaccaactgcgttatcaaaggaagagaggtccgaagagggcagtcagctctgaggcagtacagaacagaaataagaatcgggcaaacatttacaggctcgagaagattgcttgcagagggggggagcaatgattgtgtttcaagaacccagctagtcaaaacagaggttgcagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggccatgtgaaattgtctagagggacagaaatcgttttggatgtctgtgatactagctgtgaactgatgatacccaaaggcactggggatatattggtggactgctcaggagggcagcaacactttttacaggacaatctaattgacttgggatgcccaaatattccattgctaggtcgaacagctatatatgtttgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcacgatcttaactgcaactacaacatatgcccttactgtgcatccagactgacctcagatggtctcgtcaggcacgtaactcaatgtcccaaacggaaagagaaggtcgaagaaactgaactatacttaaacctggagagaataccttggttggtgagaaaactcctacaagtgtcggagtcaacaggagtggctctaaagagaagctgctggatgatcacactccttattctgctgactgtttcaatgtcaccagttcagtccgcaccagtaggccacaaaagggcagttgaagtctatcaaatgagagaaagctatacaggtatttgcctcttcgtgttaggaagtgttctcttcgcagtctcttggctggtgaaggccctgattgatagcatcggcaatagtttcttcccggggctttccatatgcaagacatgttccattggtagcataaatggatttgaaatagagtcacacaaatgctactgcagtctattttgctgtccttactgtagggcctgctcatcggacaaaatcactcaccgaatgcatttgaatgtgtgcaaaaagagaaaggtgggtagtaatgttatgctagccgtttgcaagcgcatgtgttttaaagcaactattgaagcaagcaacagggctactttcatcagaaacatcataaactccacttttgtcatatgcatactaatcctggtgatctgtgtggttagtacctctgctgtcgacatggaaaatttaccggcaggcatctgggaaaaagaggaagacctaacaaacttctgtcatcaggagtgtcaagtaacagaaactgaatgcctttgcccatatgaggccttaatgcttagaaaaccacttttcttagatagaatagccaagggaatgaaaagcttgttgaactccacaagtttagaaacgagcttgtcaattgaagctccatggggggcaatcaatgttcaatcaactttcaaaccaacagtttcagccgccaatatagcacttagctggagttcagttgaacacaagggcaacaagatcttagtttcaggcagatcagagtcaattatgaaattagaagaaagaactggaatcagctggtgtctaggtgtggaagatgcctctgagtcaaaaacactcaccgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctgcataaggagtggccgcactcgaggaactggcgctgtaaccccacttggtgttggggggtgggaactggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttcctcccgagatcatcacactgcaccctaaaatagaagaagggttttttgatttgatgcatgtacagaaggtaatgtctgcaagcacggtttgtaagctgcaaagctgtactcatggtgtgcctggagacttacaagtctaccatgttggcaacttgttaaagggggacaaagtcaatgggcactcaatccacaagatagaatcacacctcaacacctcatggatgtcatgggatgggtgtgatttagactatttttgcaacatgggggactggccctcatgcacatacacaggggtgacacaacacaaccatgctgcattcatcaacatgcttaacattgagactgattacacaaaaacctttcactttcattcaaaaagggtcacagcacacggagacacccctcagttggacctaaaagcgagaccagcatatggtgcaggcgaaatcactgttctagtagaagttgcagatttagaactgcacacgaagaaaattgaagtgtcgggtctgaaattcgcaagtttgtcatgctccggatgttatgcttgcagctctggcatctcctgcaaagttaggattcatgtaaatgaaccggatgaattcacagtacatgtaaaaagtaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcagaaatgtgttgacattaaacttgaacatccacagagcatactcattgaacacaaaggaacgattattggcaagcagaatgacacctgtccaactaaaacaagctgctggttggaatctattaagagttttttttatgggcttaaaaacatgctgagtgggatcttcggtaatgttttcttaggcatgctcctgtttcttgctccttttatattgctaatattgtttttcttcttcgggtggagacttctcttttgccttaagtgctgtagaaggaccagaaagctgctaaagtataagcaccttagggacgaagaagagagtggttacaaaaaaatcattgaaaggctaaatgacaaaaaaggcaaaagtcgattgtttgatggagaaaggcttgcagacagaaagattgccgaactcttttcaactaaaactcatataggttga

SEQ ID NO: 3510 - RNA, 5103 nt, synthetic construct
  misc_feature 1..5103: note = derived and/or modified CDS sequence (wt) from CCHFV(ArD15786)__DQ211627.1__GP
  source 1..5103: mol_type = other RNA
atgtttctccacttcaaatttgtgttgttgactaacttcttcttttgtcaactcctatggggtggcggcggggttaccagtggaggtgggaccaatactagctcaacacaagccatcctaatatcttcaaacactccaaatagtacaatgtctgtgctggagtcatcaacaggaaccgccgcagaaacagtgccgagcacgaccatcaatacaccggacacacaggtcaccacagacagtggttctggtgaatccagcacagacccccagaccaccaacggagaagtaccttccacttctatcgccaccatcaaaacacaagagtcagaaacgcgcaggactcaaaacctaagtaccacagctggctcaggtgcatccactccaggcaacaccacatcaaacaaaccagatgtcaacttactcacatcaccaatctcggaggcaaaatcatcacccagccctagcaaaacatcgacaccgcaaactgcacatcatctctccagaagtcttctctcagcagcaactacagaaacaagtcaagctgcatcagtgatgaccacaaccagagagacaacaaccatgagcagtccaacaacagtcaaaaacagtgcaacagccacaccaacccaaggcatcaccaccagcaacacttcgaaacagactgacactacaaccctggagatcccccctaagattcaaacaacacagagccaacagactgcaacaccagcaataacacctgccaccactgctattgcattcataagccctacaaacaggtctaaaagagaatccaaggtgcaaataattttaactttctctcaaggcctcaagaaatattatagcaagatactgaaactcctacacctgacgcaagaagaagattctgaaggtctacttgaatggtgtacgcgggtacttgaacaggcatgtgatgatgactacttcaatgaaaggatagaagaatttttcataaccggaaaaggctacttcaatgatgttttgcagttcaggctgtatgacacatttagtactaccgagtcaacccagaatacttcgcccacagccaagcctttcaggtcatactatgccaaagggtctctaacctttgactcaggctatttctctgctaaatgttatccaagggcatcgaactcaggattgcagctaattaatgtcacacaacattcagtgaaaatagctaacacaccaggccccaaaatatctaatcctaagaccatcaactgtattaacttgaaagtgtcaactgacaaggatcatagcaagcttgagatcaacgtgcttctaccacaagttgctgttaatctttcaaactgccatgttttaattgaatcacatgtctgtgattactctttgaacactgatgggacaataaagctcccgaaaattgcacataatggggcttttataccaggtacttacaaaattgtaatagataagaaaaacaaattgaatgataggtgtgcactattcaccaactgcgttatcaaaggaagagaggtccgaagagggcagtcagctctgaggcagtacagaacagaaataagaatcgggcaaacatttacaggctcgagaagattgcttgcagagggggggagcaatgactgtgtttcaagaacccagctagtcaaaacagaggttacagaaattcatgaagacagttacggtggtcctggcgaaaaaatcacaatttgcaacggctccacaatagtggatcaaaggcttggcagcgaattaggttgctatacaataaacagagtgagaacctataagctctgtgagaacagtgccacagaaaagagctgtgaaatagacagtgttccagttaaatgcaaacaggggttctgcctcaaaataactcaggaaggtaggggtcatgtgaaattgtctagagggacagaaatcgttctggatgtctgtgatactagctgtgaactgatgatacccaaaggcactggggatatattggtggactgctcaggagggcagcaacactttttacaggacaatctaattgacttgggatgcccaaatattccattgctaggtcaaacggctatatatgtctgtagaatgtcaaaccatcccaagacaaccatggcttttctgttttggttcagttttggctatgtcatcacatgtgtagtgtgcaaggtgctcttctatttgctaattgtcatcgggacactaggaaaaaggctgaaacagtacagagagctaaagcctcaaacatgtattgtctgtgaatctatccctgtcaatgcaatagatgctgaaatgcatgatcttaactgcaactacaacatatgcccttactgtgcatccagactgacctcagatggcctcgtcaggcacgtaactcaatgtcccaaacggaaagagaaggtcgaagaaactgaactatacttaaacttggagagaataccttggttggtaagaaagctcctacaagtgtcggagtcaacaggagtggctctgaagagaagctgctggataatcacactccttattctgctgactgtttcaatgtcaccagttcagtccgcaccggtaggccacaaaagggcagttgaagtctatcaaataagagaaagctatacaggtatttgcctcttcgtgttaggaggtgttctcttcgcagtctcttggctggtgaaggccctgattgatagcatcggcaatagtttcttccctgggctttccatatgcaagacgtgttccattggtagcataaatggatttgaaatagagtcacacaaatgctactgcagtctactctgctgtccttactgtagggcctgctcatcggacaaaatcactcaccgaatgcatttgaatgtgtgcaaaaagagaaaggtgggtagtaatgttatgctagccgtttgcaaacgcatgtgttttaaagcaactattgaagcaaacaacagggctactttcatcagaaacatcataaactccacttttgtcatatgcatactaatcctggtgatctgtgtagttagtacctctgctgtcgacatggaaaatttaccggcaggcatctgggaaaaagaggaagacctaacaaacttctgtcatcaggagtgtcaagtaacagaaactgaatgcctttgcccatatgaggccttaatgcttagaaagccactttccttagatagtatagccaagggaatgaaaagcttgttgaactccacaagtttagaaacgagcttgtcaattgaagctccatggggggcaatcaatgttcaatcaaccttcaaaccaacaatttcagccgccaacatagcacttagctggagttcagttgaacacaagggcaacaagatcttagtttcaggcagatcagagtcaattatgaaattagaagaaagaactggaatcagctggtgtctaggtgtggaagatgcttctgaatcaaaaacactcactgtttctgttatggatctgtctcaaatgtattctcctgttttcgagtacctgtcaggtgaccgacaggtggaggagtggccaaaagcaacctgcacaggtgactgtccagaaagatgtggctgcacttcatcaacctgcctacataaggagtggccgcactcgaggaactggcgctgtaaccccacttggtgttggggggtgggaaccggctgcacctgctgtgggctagatgtaaaggatctcttcacagactacatgttggttaaatggaaagtggaatatataaaaacagaagccataatatgtgttgagcttactagtcaagagaggcagtgtagtttaattgaagcaggcacaaggtttaacctaggccctgtgacaataactctatcagaaccaaggaacgtacagcagaggcttccccccgagatcattacactgcaccctaaaatagaagaagggttttttgatttgatgcatgtgcagaaggtaatgtctgcaagcacggtttgtaagctgcaaagctgtactcacggtgtgcctggagacttacaagtctaccatgttggcaacttgttaaagggggacaaagtcaatgggcactcaatccacaagatagaatcgcacctcaacacctcatggatgtcatgggatgggtgtgatttagattatttttgcaacatgggggactggccctcatgcacatacacaggggtgacacaacacaaccgtgctgcattcatcaacatgcttaacattgagactgattacacaaaaacttttcactttcattcaaaaagggtcacagcacacggagacacccctcagttggacctaaaagcgaggccaacatatggtgcaggcgaaatcactgttctagtggaagttgcagatttagaactacacacgaagaaaattgaagtgtcgggtctgaaattcgcaagtttgacatgctctggatgttatgcttgcagctctggcatctcctgcaaagttaggattcatgtaaatgaaccggatgaattcacagtacatgtaaaaagcaatgacccagatgttgtagcagcaggatcaagtctcatggctagaaagatagagtctggggccgacagcacgtttaaggctttttcatcaatgccaaaaaactctctatgtttttacatagtagaaagagattattgtagcagctgtacagatgatgacactcaaaaatgcgttgacataaaacttgaacatccacaaagcatacttattgaacacaaaggaacgattattggcaagcaaaatgacacctgtccaactaaaacaagctgctggttggaatctatcaagagtttcttttatgggcttaaaaatatgctgagtgggatcttcggtaatattttcttaggcatgctcctgtttcttgctccttttgtattgctaatattgtttttcttcttcgggtggagacttctcttttgccttaagtgctgtagaaggactagaaagctgctaaagtataagcaccttagggacgaagaagagagtggttacaaaaaaatcattgaaaggctaaatgacaagaagggcaaaagtcgattgtttgatggagaaaggcttgcagacagaaagattgccgaactcttttcaactaaaactcatgtaggttga

SEQ ID NO: 3511 - RNA, 5100 nt, synthetic construct
  misc_feature 1..5100: note = derived and/or modified CDS sequence (wt) from CCHFV(UCCR4432)__KY484047.1__GP
  source 1..5100: mol_type = other RNA
atgttctgccttaggctcgtgctgctaatcaatcttgccctttgtcagctccttgagggcaatgatggagttaccagtgcagatgaaatcaattccaacacaacacagaccagcctgggacttccaaccattctgaatagtacaactcctgcaccaggaccatcaatagatgctaccatggaggcagtaccaggcacgaccaacagtgtgctggaaacacaggttaccatggacagtggctctggtgagctcagcacagatcctacaaccactagggaagcaacaacccccatcactgctgccactgtcagtgcgcaggaaacaaaaacacacatgactcagaacccaggaaccacagtagatccagacaccactacctccaataccaccacatcgattgaaccaatcaccactccaccaacatcaccgaccccacaagcaactccaacacccagctacagcgagacacctacactgccgaacacacatcatctctccagaagtcttctttcagctgtgggcactgaagcaggtcagacggcaccagcaacgcccacggctgaagtggccttggccccaggcggctcatctacagctgagagcaacacaatatccataccagctcaagacaccaccatcagtggtgtttcgaaacaggacaacccaacaaccacaggaatctccccagaggcccagacaatgcagagccaacaggccgttgcaccagtgaccacacctgccaccgccatctctgcacccacaagcccaacgaacagatccaaaagggagtctaaagtgcaaataattctgacctttcctcaaggtctgaagaaatactacagcaaaatactgaaattcctacacttaactcaagaagaggactctgaaggcctacttgaatggtgcacacgagtgcttcaacaggtatgtgatgatacctacttcaatgagaggataaaagaattttttataactgggaaaggttacttcaatgatgtacttcagtttaagttgcacgacactcccgctaccaccgttccagccctggccgcctcatctacagccatgccgttcagatcatactatgccaaagggtccctaacccttgactcaggctacttctctgctaaatgttatccaagagcatcaaactcaggaatgcagctaatcaatgtcacacaacacccaatgaagatagccaacactccaggcccaaagatatccaatctcaagactataaactgtataaacttgaaggtatcaactgacaaggaacatagtgagcttgagatcaatgtgcttatacctcaggttgctgtcaacctttcaaactgttttgtttcaatcaagtcacatgtctgtgactactccctggacactgatggagcaatacgtctcccgaaagtcgcacacaacggggtttttatgccaggaacttacaaaattgttatagacaagaaaaacaagttgaatgatagatgcgcgctaatcaccaactgtgtcatcaaaggaagagaagttcgaaaggggcagtcaactttgagacagtataaaacagaaataagaattgggcaaacaattgcaggctcaagaagattgcttgcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaaaggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttttgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggtcaggggaaagcagtcgaagtctaccgggtgagagaaagctacacaagcatatgcctctttgtattaggaagtgttctctttgcggtatcctggctgataaagggtttgattgacggtatcggcaacagttttttccctgggctttctgtctgcaaaacatgctctattggcagcataaatgggttcgagatagagtctcacaaatgctattgtagtctgttttgttgtccttattgcagagcttgctcatctgacaaaatcactcaccgaatgcatttgaacgtctgcaagaaaaggaaagcgggtagcaatgttatgctggctgtctgtaagcgtatgtgctttaaggcaactgttgaagcaagcaacacagccttgctcatcaggggtatcataaattccacttttgtgatatgcgtactgatcctggttatctgtgtggtaagcacatctgctgttgacatggagaatctaccagcaggaatctgggagagagaagaagaccttacaaacttttgccaccaagaatgtcaagtaacagaaactgagtgtctttgcccgtatgaagccttaattctcagaaagcctctttacctagacagcatagccaaggggatgaaaagtctgctaaattctacgaatttagagacaagcctgtcgattgaggccccgtggggagcaatcaatgttcagtcaacttttaaaccaacagtttcagctgccaatatagcacttagctggagttcagttgaacacaggggcaacaaaatcctagtttcgggcaggtcagagtcaattatgaagctggaagaaaggaccggtatcagctggagcctaggtgtagaggatgcttctgagtcaaagacgctgactgtttctgtcatggacctatcccaaatgtattctcccgtctttgagtatctgtcaggtgatagacaggtagaagagtggccaaaagccacctgcacaggcgactgccaagagagatgtggctgcacttcttcaacctgcttgcataaagaatggccacactcgagaaactggcgatgcaaccccacttggtgttggggagtggggactggctgcacctgctgtggattggatgtgagagaccttttcacggactacatgatggttaagtggaaagtggaatatgtaaaaacagaagctataatgtgtgttgagctaaccagtcaggagaggcaatgtagtttgattgaagcaggtacaagatttaacctaggccctgtgacaataaccctgtcagagccaagaaacatccagcaaaggctcccttccgaaatcgttacactgcaccctaagatagaagaagggttctttgacttgatgcatgtgcaaaaggtactatctgcaagtacagtctgcaaactacagagctgcacacacggtgtccctggcgatctacaggtctaccatgttggcaacctactgaaaggagataaggtcaatgggcactcaatccacaagatagagtcccatttcaacacttcatggatgtcatgggatggatgtgatctagactacttctgcaacatgggtgactggccctcatgtacatacactggagtgacacagcacaaccgtgcggcattcatcaatatgctcaatattgagactgattatacaaagactttccacttccattccaagagagtaacggcacatggtgacacccctcaactggatctgaaggcaaggcctacatatggtgcaggcgaagtcactgttctagtagaggttgcagatctggagctacacaccaagaaaattgaagtgtcaggactgaagtttgcaagtctgacctgctccggttgttacgcctgcagctccggtatctcctgcaaagttagaattcatgtgaatgaaccagatgaatttactgtacatgtgaaaagcagtgatccagatgttgtggcagcaggatcaagtttgatggcaaggaaaatagagtttggggctgacagcaccttcaaagctttctcatcaatgcctaaaaactctttgtgcttctatatagtggaaagagactactgcagcagctgcaccaatgatgacactcagaagtgtgttgacacaaagctcgaacatccacaaagcatattaattgagcataagggaacaataattggcaaacaaaacgacacctgttcgaccaaaacaagctgttggctagaatcagtcaagagttttttttatggactaaaaaacatgctgggtggcatcttcggtaatgtcttcttaggcatcttcctgttccttgctccttttgcactgctaatattcttcttcttcttcgggtggaggcttctgttctgtctgaagtgttgcagaagaaccagggggctgctaaagtataaacaacttaaggacgaagaagaagccgggtacaagaaaatcatcgagaggctaaatgacaaaaaaggcaaaagtcgactgtttgacggagagaggcttgcagataggaagattgcagaactcttttcaaccaaaactcatatagggtaa

SEQ ID NO: 3512 - RNA, 5100 nt, synthetic construct
  misc_feature 1..5100: note = derived and/or modified CDS sequence (wt) from CCHFV(Nakiwogo)__KX013484.1__GP
  source 1..5100: mol_type = other RNA
atgttctgccttaagctcgtgctgctaatcaatcttaccctttgtcagcttcttgaaggcaatgatagagttactagtgcagatggaatcaattccaacacaacacagaccaacttaggaatttcaactattctgaatagtacaactcctgcaccaggaccatcaacagatactaccatggagacagttccaagcacggccgacagcatgctggaaacacaggttaccacggacagtggctctggtgagcccagcacagagcctacaaccaccggagaagcaacatcctctaccactgctgccactgtcagtatgcaggaaacaaaaaaacacatgactcagaacacaagatccacagcagacccagacaccaccacccccaactccaccacatcggttgaaccaaccactatcccaccaacgtcaccgatcccacaagcaactccaacacccggccacggcaaggcacctacactgccgaacacacaccatctctccagaagtcttctttcagctgtaagcactgaagcaggtcagacaacaccagcaacatccacaactgaggcggcttcagccccaagcagctcatcgacagctgagaacaacacggtgtctcaaccagctcaagacaccaccaccagtggtgtttcggaacagtacaacccaacaaccacaggaatctcaccaaaggcccagacaatgcagggtcaacaggctattgtaccagtgaccacacctgtcaccaccacctttacacctacaaacccaacgaatagatccaagagggagtctaaagtgcaaataattttaacctttcctcaaggtctgaagaagtactacagcaaaatattgaaactcctacacttaactcaagaagaggactctgaaggcttacttgaatggtgcacacgagtacttcaacaggtatgtgatgatacctatttcaatgagaggatagaagaattttttataactgggaaaggttacttcaatgatgtacttcagttcaagttgcatgacactcctaccaccactgtttcggccctggccgcctcatctacagccatgcctttcagatcatactatgctaaagggtctctaacccttgactcaggctatttctctgctaaatgttacccaagagcatcaaactcaggaatgcagttaatcaatgtcacacaacacccaatgaagatagccaacactccgggccctaaaacatccaatctcaagactatgaactgtataaacttgaaggtatcaactgacaaggaacatagcgagcttgagatcaatgtgctcatacctcaggttgctgttaacctttcaaactgtcttgtttcaatcaagtcacatgtctgtgactactccctagacactgacggagcaatacgcctcccgaaagtcgcatacaacggggtttttatgccagggacttacaaaattgttatagacaagaaaaacaggttgaatgataggtgtgcactaatcacaaactgtgtcattaaaggaagagaagttcgaaaggggcagtcaactttgagacagtataaaacagaaataagaattgggcaaacactcatgggctcaagaagattgcttgcagaaggagtgagcaatgactgcgtttcaaggacccagctaatcaaaacagaagttgcagagattcacgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggattgctcaggaggacagcagcacttcttgcaggacaacttgattgacttaggttgcccaaatgtaccattactaggcaagatggcaatatatatctgcaggatgtcgaaccatcctaagaccaccatggcttttttgttctggttcagttttggctatgtcatcacatgcgtagtatgcaaagtgctcttctatctgctaattgtcattgggacactaggaaagaaacttaaacagtatagggaactaaaacctcagacatgcattgtctgtgaatcaatccctgtcaatgtaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccttggttggtaagaagactactgcaagtgtcagagtcaacagggatggctctaaagagaagttgctggatgaccacactcctcattctgctagtagtttcattgtctccagttcaatctgctccagttggtcaggagaaagcaatcgaagtctaccaggtgagagaaagttacacaagcatgtgcctctttgtattaggaagtgttctctttgcagtctcctggctggtaaagggtttgattgacggtatcggcaacagttttttccctgggctttctgtctgcaaaacatgctctattggcagcataaatggatttgaaatagagtcccacaaatgctattgtagtctgttctgttgtccttactgcagagcttgctcatctgataaaatcactcaccgaatgcatttgaatatctgcaagaggaggaaagtgggtagcaatgttatgctggctgtctgtaagcgtatgtgctttaaggcgactgttgaagcaagcaactcagccctgctcatcagaagcatcataaactccacctttgtgatatgcgtgctgattctagttatctgtgtggtaagcacatctgctgtcgacatggagaatctaccagcaggcatctgggagagagaagaagaccttacaaacttctgccatcaagaatgccaagtgacagagactgagtgtctttgcccgtatgaagccttaattctcagaaagcccctttacctggatagcatagccaaggggatgaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggatctgtctcaaatgtattctcctgtctttgagtatctgtcaggtgatagacaagtagaagagtggccaaaggccacttgcacaggcgactgcccagagagatgtggctgcacctcctcaacctgcttgcataaagaatggccgcactcgagaaactggcgatgcaaccccacttggtgttggggagtagggactggctgcacctgctgcggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctgggccctgtgacaataaccctgtcagagccaagaaatgtccagcaaaggctcccttccgaaatcgttacactgcaccctaagatagaggaaggattctttgatttgatgcatgtgcaaaaagtactattctgcaagcacagtttgcaagctacaagctgcacacacggtgtcccaggcgatttgcaggtctaccatgttggcaacctactgaaaggagacaaggttaatgggcactcaattcacaagatagagtctcatttcaacacttcatggatgtcatgggatggatgtgacctagactacttttgcaacatgggtgactggccttcatgtacatatactggagtgacacagcacaaccgtgcggcattcgtcaacatgctcaatattgagactgattacacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctctggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagttaggggctgacagcacctttaaagccttttcatcaatgcctaaaaactctttgtgcttttatatagtggaaagagactactgcagcagctgcaccgatgatgacactcagaagtgtgttaacacaaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggtaatgtcttcttaggcatcttcctattccttgctccttttgcactgctgatactcttcttcttcttcgggtggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgacggagagaggctcgctgacaggaagattgctgaactcttttcaaccaaaactcatatagggtga

SEQ ID NO: 3513 - RNA, 5100 nt, synthetic construct
  misc_feature 1..5100: note = derived and/or modified CDS sequence (wt) from CCHFV(UG3010)__AY900143.1__GP
  source 1..5100: mol_type = other RNA
atgttctgccttaggctcgtgctgctaatcaatcttgccctttgtcagctccttgagggcaatgatggagttaccagtgcagatgaaatcaattccaacacaacacagaccagcctgggacttccaaccattctgaatagtacaactcctgcaccaggaccatcaatagatgctaccatggaggcagtaccaggcacgaccaacagtgtgctggaaacacaggttaccatggacagtggctctggtgagctcagcacagatcctacaaccactagggaagcaacaacccccatcactgctgccactgtcagtgcgcaggaaacaaaaacacacatgactcagaacccaggaaccacagtagatccagacaccactacctccaataccaccacatcgattgaaccaatcaccactccaccaacatcaccgaccccacaagcaactccaacacccagctacagcgagacacctacactgccgaacacacatcatctctccagaagtcttctttcagctgtgggcactgaagcaggtcagacggcaccagcaacgcccacggctgaagtggccttggccccaggcggctcatctacagctgagagcaacacaatatccataccagctcaagacaccaccatcagtggtgtttcgaaacaggacaacccaacaaccacaggaatctccccagaggcccagacaatgcagagccaacaggccgttgcaccagtgaccacacctgccaccgccatctctgcacccacaagcccaacgaacagatccaaaagggagtctaaagtgcaaataattctgacctttcctcaaggtctgaagaaatactacagcaaaatactgaaattcctacacttaactcaagaagaggactctgaaggcctacttgaatggtgcacacgagtgcttcaacaggtatgtgatgatacctacttcaatgagaggataaaagaattttttataactgggaaaggttacttcaatgatgtacttcagtttaagttgcacgacactcccgctaccaccgttccagccctggccgcctcatctacagccataccgttcagatcatactatgccaaagggtccctaacccttgactcaggctacttctctgctaaatgttatccaagagcatcaaactcaggaatgcagctaatcaatgtcacacaacacccaatgaagatagccaacactccaggcccaaagatatccaatctcaagactataaactgtataaacttgaaggtatcaactgacaaggaacatagtgagcttgagatcaatgtgcttatacctcaggttgctgtcaacctttcaaactgttttgtttcaatcaagtcacatgtctgtgactactccctggacactgatggagcaatacgtctcccgaaagtcgcacacaacggggtttttatgccaggaacttacaaaattgttatagacaagaaaaacaagttgaatgatagatgcgcgctaatcaccaactgtgtcatcaaaggaagagaagttcgaaaggggcagtcaactttgagacagtataaaacagaaataagaattgggcaaacaattgcaggctcaagaagattgcttgcagaaggagtgagcaatgactgtgtttcaaggacccagctaatcaaaacagaagttgcagagattcatgaagatagttatggtgggcctggagaaaaaataacaatctgcaacggctccacaatcgtggaccaaagactcggtagcgaactaggctgctacacaatcaaccgtgtgaagacttataagctttgtgagaatagtgctacagagaagggttgtgagatcgatagtgtcccagtcaaatgcaaacaagggttctgcctcaaagtaacccaagagggcaggggccatgtaaaactgtccagaggaacggaaattgtcctagatgtatgtgacaccagttgtgagttgatgatacccaagggcactggggacatattggtggactgctcaggaggacagcagcactttttgcaggataacttgattgacttaggttgtccaaatgtaccattattaggcaagatggcaatatatatctgcaggatgtcaaatcatcctaaaactaccatggcttttctgttctggtttagctttggctatgtcatcacatgcatagtatgtaaagtgcttttctatctgctaattgtcatcgggacactaagtaagaaacttaaacagtatagggaattaaaacctcaaacatgcattgtctgtgaatcaacccctgttaatgcaatagatgctgaaatgcacgagctcaattgtaattacaacatatgcccatactgcgcgtccagactaacttcagatggactagtcagacatgtgaatcaatgtcccaaaaggaaagaaaaggtcgaggagactgaactatacttgaacctggagaggataccttggctagtaaggaggctactacaagtgtcagagtcaacggggatggctctaaagagaagttgctggatgaccacactcctcattctgctagtagtttcattatcgccagttcaatctgctccagttggtcaggggaaagcagtcgaagtctaccgggtgagagaaagctacacaagcatatgcctctttgtattaggaagtgttctctttgcggtatcctggctgataaagggtttgattgacggtatcggcaacagttttttccctgggctttctgtctgcaaaacatgctctattggcagcataaatgggttcgagatagagtctcacaaatgctattgtagtctgttttgttgtccttattgcagagcttgctcatctgacaaaatcactcaccgaatgcatttgaacgtctgcaagaaaaggaaagcgggtagcaatgttatgctggctgtctgtaagcgtatgtgctttaaggcaactgttgaagcaagcaacacagccttgctcatcaggggtatcataaattccacttttgtgatatgcgtactgatcctggttatctgtgtggtaagcacatctgctgttgacatggagaatctaccagcaggaatctgggagagagaagaagaccttacaaacttttgccaccaagaatgtcaagtaacagaaactgagtgtctttgcccgtatgaagccttaattctcagaaagcctctttacctagacagcatagccaaggggatgaaaagtctgctaaattctacgaatttagagacaagcctgtcgattgaggccccgtggggagcaatcaatgttcagtcaacttttaaaccaacagtttcagctgccaatatagcacttagctggagttcagttgaacacaggggcaacaaaatcctagtttcgggcaggtcagagtcaattatgaagctggaagaaaggaccggtatcagctggagcctaggtgtagaggatgcttctgagtcaaagacgctgactgtttctgtcatggacctatcccaaatgtattctcccgtctttgagtatctgtcaggtgatagacaggtagaagagtggccaaaagccacctgcacaggcgactgccaagagagatgtggctgcacttcttcaacctgcttgcataaagaatggccacactcgagaaactggcgatgcaaccccacttggtgttggggagtggggactggctgcacctgctgtggattggatgtgagagaccttttcacggactacatgatggttaagtggaaagtggaatatgtaaaaacagaagctataatgtgtgttgagctaaccagtcaggagaggcaatgtagtttgattgaagcaggtacaagatttaacctaggccctgtgacaataaccctgtcagagccaagaaacatccagcaaaggctcccttccgaaatcgttacactgcaccctaagatagaagaagggttctttgacttgatgcatgtgcaaaaggtactatctgcaagtacagtctgcaaactacagagctgcacacacggtgtccctggcgatctacaggtctaccatgttggcaacctactgaaaggagataaggtcaatgggcactcaatccacaagatagagtcccatttcaacacttcatggatgtcatgggatggatgtgatctagactacttctgcaacatgggtgactggccctcatgtacatacactggagtgacacagcacaaccgtgcggcattcatcaatatgctcaatattgagactgattatacaaagactttccacttccattccaagagagtaacggcacatggtgacacccctcaactggatctgaaggcaaggcctacatatggtgcaggcgaagtcactgttctagtagaggttgcagatctggagctacacaccaagaaaattgaagtgtcaggactgaagtttgcaagtctgacctgctccggttgttacgcctgcagctccggtatctcctgcaaagttagaattcatgtgaatgaaccagatgaatttactgtacatgtgaaaagcagtgatccagatgttgtggcagcaggatcaagtttgatggcaaggaaaatagagtttggggctgacagcaccttcaaagctttctcatcaatgcctaaaaactctttgtgcttctatatagtggaaagagactactgcagcagctgcaccaatgatgacactcagaagtgtgttgacacaaagctcgaacatccacaaagcatattaattgagcataagggaacaataattggcaaacaaaacgacacctgttcgaccaaaacaagctgttggctagaatcagtcaagagttttttttatggactaaaaaacatgctgggtggcatcttcggtaatgtcttcttaggcatcttcctgttccttgctccttttgcactgctaatattcttcttcttcttcgggtggaggcttctgttctgtctgaagtgttgcagaagaaccagggggctgctaaagtataaacaacttaaggacgaagaagaagccgggtacaagaaaatcatcgagaggctaaatgacaaaaaaggcaaaagtcgactgtttgacggagagaggcttgcagataggaagattgcagaactcttttcaaccaaaactcatatagggtaa

SEQ ID NO: 3514 - RNA, 5100 nt, synthetic construct
  misc_feature 1..5100: note = derived and/or modified CDS sequence (wt) from CCHFV(Semunya)__DQ094832.1__GP
  source 1..5100: mol_type = other RNA
atgttctgccttaagctcgtgctgctaatcaatcttgccctttgtcagcttcttgaaggcaatgatagagttactagtgcagatggaatcaattccaacacaacacagaccaacttaggaatttcaactattctgaatagtacaactcctgcaccaggaccatcaacagatactaccatggagacagttccaagcacggccgacagcatgctggaaacacaggttaccacggacagtggctctggtgagcccagcacagagcctacaaccaccggagaagcaacatcctctaccactgctgccactgtcagtatgcaggaaacaaaaacacacatgactcagaacacaagatccacagcagacccagacaccaccacccccaacaccaccacatcggttgaaccaaccactatcccaccaacgtcaccgatcctacaagcaactccaacacccggccacggcaaggcacctacactgccgaacacacaccatctctccagaagtcttctttcagctgtaagcactgaagcaggtcagacaacaccagcaacatccacaactgaggcggcttcagccccaagcagctcatcgacagctgagaacaacacgatgtttcaaccagctcaagacaccaccaccagtggtgtttcggaacagtacaacccaacaaccacaggaatctcaccaaaggcccagacaatgcaggctcaacaggctattgtaccagtgactacacctgtcaccacaacctttacacctataaacccaacgaatagatccaagagggagtctaaagtgcaaataattttaacctttcctcaaggtctgaagaagtactacagcaaaatattgaaactcctacacttaactcaagaagaggactctgaaggcttacttgaatggtgcacacgagtacttcaacaggtatgtgatgatacctatttcaatgagaggatagaagaattttttataactgggaaaggttacttcaatgatgtacttcagttcaagttgcatgacactcctaccaccactgttccggccctggccgcctcatctacagccatgcctttcagatcatactatgctaaagggtctctaacccttgactcaggctatttctctgctaaatgttacccaagagcatcaaactcaggaatgcagctaatcaatgtcacacaacacccaatgaagatagccaacactccgggccctaaaacatccaatctcaagactatgaactgtataaacttgaaggtatcaactgacaaggaacatagcgagcttgagatcaatgtgctcatacctcaggttgctgttaacctttcaaactgtcttgtttcaatcaagtcacatgtctgtgactactccctagacactgacggagcaatacgcctcccgaaagtcgcatacaacggggtttttatgccagggacttacaaaattgttatagacaagaaaaacaggttgaatgataggtgtgcactaatcacaaactgtgtcattaaaggaagagaagttcgaaaggggcagtcaactttgagacagtacaaaacagaaataagaattgggcaaacactcatgggctcaagaagattgcttgcagaaggagtgagcaatgactgcgtttcaaggacccagctaatcaaaacagaagttgcggagattcatgaagatagctacggtgggcctggagaaaaaataacaatctgcaacggctccacaatcgtggaccaaaggcttggtagcgaactaggttgctacacaattaaccgcgtgaagacttataagctttgtgagaacagtgccacagaaaagggttgtgagatcgatagtgttccagtcaaatgcaaacaagggttctgcctcaaagtaacccaagagggcaggggccatgtgaaactatctagaggaacggaaattgtcctggatgtgtgtgacaccagttgtgagttgatgatacctaaaggcactggagacatattggtggactgctcaggaggacagcagcacttcttgcaggacaacttgattgacttaggttgcccaaatgtaccattactaggcaagatggcaatatatatctgcaggatgtcgaaccatccaaagaccaccatggcttttttgttctggttcagttttggctatgtcatcacatgcgtagtatgcaaagtgctcttctatctgctaattgtcatcgggacactaggaaagaaacttaaacagtatagggaactaaaacctcagacatgcattgtctgtgaatcaatccctgtcaatgcaatagatgctgaaatgcacgagctcaattgcaattacaatatatgcccatactgtgcgtccagactgacttcagatggactagttagacatgtgactcaatgtcccaaaaggaaggaaaaggtcgaggagactgagctgtacttgaacctggagaggataccctggttggtaagaagactactgcaagtgtcagagtcaacagggatggctctaaagagaagttgctggatgaccacactcctcattctgctagtagtttcattgtctccagttcaatctgctccagtaggtcaggagaaagcaatcgaagtctaccaggtgagagaaagttacacaagcatatgcctctttgtattaggaagtgttctctttgcagtctcctggctggtaaagggtttgattgacggtatcggcaacagttttttccctgggctttctgtctgcaaaacatgctctattggcagcataaatggatttgaaatagagtcccacaaatgctattgtagtctgttctgttgtccttactgcagagcttgctcatctgacaaaatcactcaccgaatgcatttgaatatctgcaagaggaggaaagtgggtagcaatgttatgctggctgtctgtaagcgtatgtgctttaaggcgactgttgaagcaagcaactcagccctgctcatcagaagcatcataaactccacctttgtgatatgcgtgctgattctagttatctgtgtggtaagcacatctgctgtcgacatggagaatctaccagcaggcatctgggagagagaagaagaccttacaaacttctgccatcaagaatgccaagtgacagagactgagtgtctttgcccgtatgaagccttaattctcagaaagccccttttcctggatagcatagccaaggggaagaaaagtctgttaaattctacgaacttagagacaagcctgtcgattgaggccccatggggagcaatcaatgttcagtcaacttttaaaccaacagtttcagctgccaacatagcacttagctggagttcagttgaacacaggggcaacaaaatcctagtttcgggcaggtcagagtcaattatgaaactggaagaacggaccggcatcagctggagcctaggtgtagaggatgcttctgagtcaaagacgcttactgtttctgtcatggacctgtctcaaatgtattctcctgtctttgagtatctgtcaggtgatagacaagtagaagagtggccaaaggccacttgcacaggcgactgcccggagagatgtggctgcacctcctcaacctgcttgcataaagaatggccgcactcgagaaactggcgatgcaaccccacttggtgttggggagtagggactggctgcacctgctgtggactggatgttagagaccttttcacggactacatgatggtcaagtggaaagtggaatatgtaaaaacagaagctataatgtgtgttgagctaactagtcaggaaaggcagtgtagtttaattgaggcaggtacaaggtttaacctaggccctgtgacaataaccctgtcagagccaagaaatgtccagcaaaggcttccctccgaaatcgttacactgcaccctaagatagaggaaggattctttgatttgatgcatgtgcaaaaagtactattctgcaagtacagtttgcaagctacaagctgcacacacggcgtcccaggcgatttgcaggtctaccatgttggcaacctactgaaaggagacaaggttaatgggcactcaattcacaagatagagtctcatttcaacacctcatggatgtcatgggatggatgtgacctagactacttttgcaacatgggtgactggccttcatgtacatatactggagtgacacagcacaatcgtgcggcattcgtcaacatgctcaatattgagactgattatacaaagacttttcacttccattccaagagggttacggcacacggtgacacccctcaactggatctgaaggcaagaccaacatatggtgcaggcgaggtcactgttctagtggaggttgcagatctggagctacacactaagaaaatagaagtgtcagggttgaagtttgcaagtctgacctgctccggttgttatgcctgcagttccggcatctcctgcaaagttagaattcatgtgaatgaaccagatgagttcacagtacacgtgaaaagcaatgatccagacgttgtggcagcaggatcaagtctgatggcaaggaaaatagagtttggggctgacagcacctttaaagccttttcatcaatgcctaaaaactctttgtgcttttatatagtggaaagagactactgcagcagctgcaccgatgatgacactcagaagtgtgttaacataaagctcgaacatccacaaagcatattaattgagcataagggaacaataattggtaagcaaaatgacacctgtccgaccaaaacaagctgctggctagaatcagtcaagagttttttttatggactgaaaaacatgctgggtggcatcttcggcaatgtcttcttaggcatcttcctattccttgctccttttgcactgctgatactcttcttcttctttggatggaggcttctgttctgtctgaagtgttgcagaaggaccaggggtctgctaaagtataaacaacttaaggatgaagaagaagccgggtacaagaaaatcatcgagaggctgaatgacaaaaagggcaaaagtcgactttttgatggagagaggctcgctgacaggaagattgctaaactcttctcaaccaagactcatatagggtga

SEQ ID NO: 3515 - RNA, 5094 nt, synthetic construct
  misc_feature 1..5094: note = derived and/or modified CDS sequence (wt) from CCHFV(79121)__AB069673.1__GP
  source 1..5094: mol_type = other RNA
atgttattccactttaaatttatgttgctgattaattttattctttgtcatctcctttgggggggtggtggagtcaccggtggggtcgaaacaaactccagctcaacacaagccatccagacgccaccagtcacctcaaacagcacaactccaggtccatcaacagacactgccacggagacagcgtcaagcatgaccactagcacgccggacacacaagtaaccacagacaatggctctggtgagcctagcacagatcctctaaccaccaatgaggcaaccccccctctctctgtcaccactgcccaaacgacagagacgaaaaagcacacaaccctggaccccagcacctcgacaaatccagatgccaccaccccgagtatcaccatattgagtgcatcaaatactagcttgcccatatcatcagtgcatgcaagcccatcacccagctccagtgaagaaccaacaccacaaaatgcacaccatctctccagaagtcttctctcagcagtaagtacagagacaggtcaaatagcatcagcagcgaccgcagccaaagagattacaaccaaaaatagcccgccaacagccggaaatgacacaatggtcacatcagctccaaacggcaatatacgcaacactccagaacaggccaaccccacagccccagaggcttcccccaagattcaaacaacacaaaaccaacagaccgttacaccagaggctacacctatcaccacaatcactgcactcacagacctaacaaacaggtccaaaagggactccaaggtacagaaaattctgaccttttctcaaggcctcaagaagtactatagcaagatattgaaactcttgcaattaacacaagaagaagattctgaaggtctgcttgagtggtgcacacgggtgctggaacaagcatgtgatgatgactacttcaataagaggattgaagaatttttcataaccggaaagggctacttcaatgatgttctacagttcaggttacatgacgcacttagcaacaccgagcctgcccagaccacttcacctacagctgtacccttcaaatcttactatgccaaagggtctctaacctttgattcaggctacttttctgctaggtgctatccgagagcatcaaactcaggattgcagctgattaatgtcacacaacaccctgtaaaaatagctaacactccaggtccaaaattatctaatctcaagaccattaactgcataaacctgaaagtgtcaactgacaaagaacatagtgagcttgaggtcaacgtgcttctacctcaggttgccgttaatctctcaaactgtcatgtttccattaagtcacatgtttgtgattattccttggacaccgatggagcaataaaactccctagagttgcacacaatggggtttttataccaggtacatacaagattgtgatagacaaaaaaaacaacctaaatgataggtgtacattaatcaccaattgtgtcataaagggaagagaagtccgaaaagggcagtcggctttgaggcagtataaaacagaaataaggattgggcagacattcacaggctcgagaagattacttgcagaaggaggaagcagtgactgcatttcaagaactcagctagttaaaacggaggttgcagaaattcatgaggacagttacggtgggcctggtgagaaaataacaatctgcaatggttccacaattgtagatcaagggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcatcggcaacagcttctcccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaagatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcacagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaccttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggttaa

SEQ ID NO: 3516 - RNA, 5094 nt, synthetic construct
  misc_feature 1..5094: note = derived and/or modified CDS sequence (wt) from CCHFV(7001)__AB069670.1__GP
  source 1..5094: mol_type = other RNA
atgttattccactttaaatttatgttgctgattaattttattctttgtcatctcctttgggggggtggtggagtcaccggtggggtcgaaacaaactccagctcaacacaagccatccagacgccaccagtcacctcaaacagcacaactccaggtccatcaacagacactgccacggagacagcgtcaagcatgaccactagcacgccggacacacaagtaaccacagacaatggctctggtgagcctagcacagatcctctaaccaccaatgaggcaaccccccctctctctgtcaccactgcccaaacgacagagacgaaaaagcacacaaccctggaccccagcacctcgacaaatccagatgccaccaccccgagtatcaccatattgagtgcatcaaatactagcttgcccatatcatcagtgcatgcaagcccatcacccagctccagtgaagaaccaacaccacaaaatgcacaccatctctccagaagtcttctctcagcagtaagtacagagacaggtcaaatagcatcagcagcgaccgcagccaaagagattacaaccaaaaatagcccgccaacagccggaaatgacacaatggtcacatcagctccaaacggcaatatacgcaacactccagaacaggccaaccccacagccccagaggcttcccccaagattcaaacaacacaaaaccaacagaccgttacaccagaggctacacctatcaccacaatcactgcactcacagacctaacaaacaggtccaaaagggactccaaggtacagataattctgaccttttctcaaggcctcaagaagtactatagcaagatattgaaactcttgcaattaacacaagaagaagattctgaaggtctgcttgagtggtgcacacgggtgctggaacaagcatgtgatgatgactacttcaataagaggattgaagaatttttcataaccggaaagggctacttcaatgatgttctacagttcaggttacatgacgcacttagcaacaccgagcctgcccagaccacttcacctacagctgtacccttcaaatcttactatgccaaagggtctctaacctttgattcaggctacttttctgctaggtgctatccgagagcatcaaactcaggattgcagctgattaatgtcacacaacaccctgtaaaaatagctaacactccaggtccaaaattatctaatctcaagaccattaactgcataaacctgaaagtgtcaactgacaaagaacatagtgagcttgaggtcaacgtgcttctacctcaggttgccgttaatctctcaaactgtcatgtttccattaagtcacatgtttgtgattattccttggacaccgatggagcaataaaactccctagagttgcacacaatggggtttttataccaggtacatacaagattgtgatagacaaaaaaaacaacctaaatgataggtgtacattaatcaccaattgtgtcataaagggaagagaagtccgaaaagggcagtcggctttgaggcagtataaaacagaaataaggattgggcagacattcacaggctcgagaagattacttgcagaaggaggaagcagtgactgcatttcaagaactcagctagttaaaacggaggttgcagaaattcatgaggacagttacggtgggcctggtgagaaaataacaatctgcaatggttccacaattgtagatcaaaggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcatcggcaacagcttcttccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaagatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggataacatagccaagggaatgaaaagcctgttgaactccacgagcttagaaactagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggttaa

SEQ ID NO: 3517 - RNA, 5094 nt, synthetic construct
  misc_feature 1..5094: note = derived and/or modified CDS sequence (wt) from CCHFV(YL16070)__KY354081.1__GP
  source 1..5094: mol_type = other RNA
atgttattccactttaaatttatgttgctgattaattttattctttgtcatctcctttgggggggtgttggagtcaccggtggggtcgaaacaaactccagctcaacacaagccatcccgacgccaccagtcacctcaaacagcacaactccaggtccatcaacagacactgccacggagacagcgtcaagcatgaccactagcacgccggacacacaagttaccacagacaatggctctggtgaacccagcacagatcctctaaccaccaatgaggcaaccccccccctctctgtcaccactgcccaaacaaaagaaacaaaaaagcacacaaccctagaccccaacacctcggcaaatccagatgccaccaccccgagtatcactatattgagtgcatcaaatactagcttgcccacatcatcagtgcatgcaagcccatcacccagctccagtgaagaaccaacaccacaaaatgcacaccatctctccagaagtcttctctcagcagtaagtacagagacgggtcaaacagcgtcagcaacgaccgcaaccaaagagattacaaccaaaaatagcccgccaacagccggaaatgacacaatggtcacatcagctccaaacggcaatacacgcaacactccagaacaggctaaccccacagccccagaggcttccctcaagattcaaacaacacaaaaccaacagaccgttacaccagaggctacacctatcaccacagtcactgcactcacagacctaacaaacaggtccaaaagggactccaaggtacagataattctgaccttctctcaaggcctcaagaagtactatagcaagatattgaaactcttgcaattgacacaagaagaagactctgaaggtctgcttgagtggtgcacacgggtgctagaacaagcatgtgatgatgactacttcaataagaggattgaagaatttttcataactggaaagggctacttcaatgatgttctgcagttcaggttacatgacgcacttagcaacaccgagcctgcccagaccacttcacctacagctgtacccttcaaatcttactatgccaaagggtctctaacctttgattcaggctacttttctgctaggtgctatccgagagcatcaaactcaggattgcagctgattaatgtcacacagcaccctgtaaaaatagctaacactccaggtccaaaactatctaatctcaagaccattaactgtataaacctgaaagtgtcaactgacaaagaacatagtgagcttgaggtcaacgtgcttctacctcaggttgccgttaatctctcaaactgccatgtttccattaagtcacatgtttgtgattactccttggacaccgatggagcaataaaactccctagagttgcacacaatggggtttttataccaggtacttacaagattgtgatagacaaaaaaaacaacctaaatgataggtgtacattaaccaccaattgtgtcataaagggaagagaagtccgaaaagggcagtcggctttgaggcagtataaaacagaaataaggattgggcagacagtcacaggctcgagaagattacttgcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagtgaattgggctgctatacaatcaacagagtaaaatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcaacagcattttttacaaaacaatctgattgacttgggatgccccaatgtcccattactgggtaaaatggccatatatgtctgcaggatgtcaaaccacccaaaaactaccatggcatttctgttctggttcagctttggctatgtcattacatgtatagtatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaacatatgcccatactgtgcttctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatgtcaccagtccaatctgcaccggtaggcaaagaaagggcaatcgagacctatcaagcaagagaagcctacacaggcatatgcctctttgtgttaggaagtgttctttttgcggtatcctggctgacaaaggccttgattgatggcatcggcaacagcttcttccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaaaatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcatagccaagggaatgaaaagcctgttgaactccacgagcttagaaactagtctgtcaattgaagctccgtggggagcaatcaatgttcagtcaactttcaaaccaacagtttcagctgctaacatagcacttagctggagttcagttgaacacaggggcaacaaaattttggtttcaggtagatcagagtcaatcatgaaattagaagaaagaacaggagtcagctggaacctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcatcaacctgcttacataaagagtggccacattcaagaaactggagatgtaatcctacttggtgttggggggtggggactggctgcacttgctgtgggctggatgtgaaggatttttttactgactacatgttggtaaaatggaaagtggaatatataaagacagaagctatagtgtgtgtcgagctaactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctaaaagcgagaccggcatatggtgctggcgaagtcactgttctagtggaggttgcagacttggagttgcacacaaagaaacttgaagtgtcaggtttgaaaattgcaagtttgacctgctctgggtgttatgcatgcagctctggcatctcctgcaaagttagaatccatgtaaatgaaccagacgaattcacagtgcatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaaaacaagctgctggctaaaatcatttaagggtttcttctatgggctcaaaaacatgctgagtggcatctttggaaatgtttttttaggcatcctcttattccttgctccttttgtactactgatattttttttcttttttgggtggaggcttctgttttgtctcaaatgttgcaaaaaaactaaaggactgttgaaatataagcaccttaaggacaaggaggaggctggatacaaaaaaatcattgaaaggctaaatggcaaaaaaggtaaaagtcaattgtttgatggtgaaaggcttgcaaacaggaaaattgctgagcttttttctactaaaattcacataggttaa

SEQ ID NO: 3518 - RNA, 5094 nt, synthetic construct
  misc_feature 1..5094: note = derived and/or modified CDS sequence (wt) from CCHFV(YL04057)__FJ562094.1__GP
  source 1..5094: mol_type = other RNA
atgttattccactttaaatttatgttgctgattaattttattctttgtcatctcctttgggggggtggtggagtcaccggtggggtcgaaacaaactccagctcaacacaagccatcccgacgccaccagtcacctcaaacagcacaactccaggtccatcaacagacactgccacggagacagcgtcaagcatgaccactagcacgccggacacacaagtaaccacagacaatggctctggtgaacctagcacagatcctccaaccaccaatgagacaaccccccctccctctgccaccactgcccaaacaacagagacaaaaaagcacacaaccctagaccccaacacctcgacaaatccagatgccatcaccccgagtatcaccatattgagtgcatcaaatactagcttgcccatatcatcagtgcatgcaagcccatcacccagctccagtgaagaaccaacaccgcaaaatgcacaccatctctccagaagtcttctctcagcagtaagtacagagacgggtcaaatagcatcagcaacgaccgcagccaaagagattacaactaaaaatagcccgccaacagccggaaatgacacaatgatcacatcagctccaaacggcaatacacgcaacactccagaacaggccaaccccacagccccagaggcttcccccaagattcaaacaacacaaaaccaacagactgttataccagaggctacacctatcaccacaatcactgcactcacagacctaacaaacaggtccaaaagggactccaaggtacagataattctgaccttctctcaaggcctcaagaagtactatagcaagatattgaaactcttgcaattaacacaagaagaagattctgaaggtctgcttgagtggtgcacacgggtgctggaacaagcatgtgatgatgactacttcaataagaggattgaagaatttttcataaccggaaagggctacttcaatgatgttctgcagttcaggttacatgacgcacttagcaacaccgagcctgcccagaccacttcacctacagctgtacccttcaaatcttactatgccaaagggtctctaacctttgattcaggctacttttctgctaggtgctatccgagagcatcaaactcaggattgcagctgattaatgtcacacaacaccctgtaaaaatagctaacactccaggtccaaaattgtctaatctcaagaccattaactgcataaacctgaaagtgtcaactgacaaagaacatagtgagcttgaggtcaacgtgcttctacctcaggttgccgttaatctctcaaactgtcatgtttccattaagtcacatgtttgtgattactccttggacaccgatggagcaataaaactccctagaattgcacacaatggggtttttataccaggtacatacaagattgtgatagacaaaaaaaacaacctaaatgataggtgtacattaaccaccaattgtgtcataaagggaagagaagtccgaaaagggcagtcggctttgaggcagtataaaacagaaataaggattgggcagacattcacaggctcaagaagattacttgcagaaggaggaagcagtgactgcatttcaagaactcagctagttaaaacagaggttgcagaaattcatgaggacagttacggtgggcctggtgagaaaataacaatctgcaatggttccacaattgtagatcaaaggcttggtagggaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacctaagggcactggagacattttagtggattgctcaggagggcagcagcattttttacaaaacaatctgattgacttgggatgccccaatgtcccactactgggtaaaatggccatatatgtctgcaggatgtcaaaccacccaaaaactaccatggcatttctgttctggttcagctttggctatgtcattacatgtatagcatgcagggtactcttctacttgctgattgccatcggaacagtagggaaaaagctaaaacagtatagagagctgaaaccacaaacatgcattgtttgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagaggagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcataggcaatagcttcttccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaaaatgggtagcaatgtcatgctggctgtctgtaaacgtatgtgctttagagcaaccattgaggcaagcaataaagctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcatagccaagggaaagaaaagcctgttgaactccacaagcttagaaactagtctgtcaattgaagctccgtggggagcaatcaatgttcagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgctcactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtagtcctacctggtgttggggggtggggactggctgcacttgctgtgggctggatgttaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataacactatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcaggtctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtaacacagcataaccgtgctgcatttatcaacatgctcaacattgagactgactatacaaaaactttccactttcattcgaagagggtcacggcacatggagatactccccagctagacctgaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaattcacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctcaaaaacatgctgagtggcatctttggaaatgtttttttaggcatcctcttattccttgctccttttgtactactgatattttttttcttttttgggtggaggcttctgttttgtctcaaatgttgcagaagaactagaggactgttgaaatataagcaccttaaggacgaagaggaggctggatacaaaaaaatcattgaaaggctaaatggcaaaaaaggtaaaagtcaattgtttgatggtgaaaggcttgcagacaggaagattgctgagcttttttctactaaaattcacataggttaa

SEQ ID NO: 3519 - RNA, 5094 nt, synthetic construct
  misc_feature 1..5094: note = derived and/or modified CDS sequence (wt) from CCHFV(79121M18)__GU477493.1__GP
  source 1..5094: mol_type = other RNA
atgttattccactttaaatttatgttgctgattaattttattctttgtcatctcctttgggggggtggtggagtcaccggtggggtcgaaacaaactccagctcaacacaagccatccagacgccaccagtcacctcaaacagcacaactccaggtccatcaacagacactgccacggagacagcgtcaagcatgaccactagcacgccggacacacaagtaaccacagacaatggctctggtgagcctagcacagatcctctaaccaccaatgaggcaaccccccctctctctgtcaccactgcccaaacgacagagacgaaaaagcacacaaccctggaccccagcacctcgacaaatccagatgccaccaccccgagtatcaccatattgagtgcatcaaatactagcttgcccatatcatcagtgcatgcaagcccatcacccagctccagtgaagaaccaacaccacaaaatgcacaccatctctccagaagtcttctctcagcagtaagtacagagacaggtcaaatagcatcagcagcgaccgcagccaaagagattacaaccaaaaatagcccgccaacagccggaaatgacacaatggtcacatcagctccaaacggcaatatacgcaacactccagaacaggccaaccccacagccccagaggcttcccccaagattcaaacaacacaaaaccaacagaccgttacaccagaggctacacctatcaccacaatcactgcactcacagacctaacaaacaggtccaaaagggactccaaggtacagaaaattctgaccttttctcaaggcctcaagaagtactatagcaagatattgaaactcttgcaattaacacaagaagaagattctgaaggtctgcttgagtggtgcacacgggtgctggaacaagcatgtgatgatgactacttcaataagaggattgaagaatttttcataaccggaaagggctacttcaatgatgttctacagttcaggttacatgacgcacttagcaacaccgagcctgcccagaccacttcacctacagctgtacccttcaaatcttactatgccaaagggtctctaacctttgattcaggctacttttctgctaggtgctatccgagagcatcaaactcaggattgcagctgattaatgtcacacaacaccctgtaaaaatagctaacactccaggtccaaaattatctaatctcaagaccattaactgcataaacctgaaagtgtcaactgacaaagaacatagtgagcttgaggtcaacgtgcttctacctcaggttgccgttaatctctcaaactgtcatgtttccattaagtcacatgtttgtgattattccttggacaccgatggagcaataaaactccctagagttgcacacaatggggtttttataccaggtacatacaagattgtgatagacaaaaaaaacaacctaaatgataggtgtacattaatcaccaattgtgtcataaagggaagagaagtccgaaaagggcagtcggctttgaggcagtataaaacagaaataaggattgggcagacattcacaggctcgagaagattacttgcagaaggaggaagcagtgactgcatttcaagaactcagctagttaaaacggaggttgcagaaattcatgaggacagttacggtgggcctggtgagaaaataacaatctgcaatggttccacaattgtagatcaagggcttggtagtgaattgggctgttatacaatcaacagagtaagatcctacaagctatgcgagaacagtgcctcagggaaaagctgtgaaatagatagcatcccagtcaaatgcaaacaagggttttgcctcaaaataacccaagaaggaagaggtcatgtaaaactgtccagagggacagaaattgttctagatgtctgtgattccagctgtgagctgatgatacccaagggcactggagacattttagtggattgctcaggagggcaacagcattttttacaaaacaatctgattgacttgggatgccccaatgtcccattactgggtaaaatggccatatatgtctgcagaatgtcaaaccacccaaaaactaccatggcatttctgttctggttcagctttggctatgtcatcacatgtatagcatgcagggtactcttctacttgctgattgccatcggaacagtagggaaaaagctaaaacagtatagagagctgaaaccacaaacatgcattgtctgtgaatctgtccctgttaatgcaatagatgctgaaatgcatgagcttaattgcagttacaatatatgcccatactgtgcatctagactgtctacagacgggctcatcaggcacgtaactcagtgtcccaaacggagggagaaggtggaagagactgagctattcttgaacttggaaagaataccttggctggtgagaaagctccttcaagtatcagagtcaacaggaatggctctaaagagaagctgttggatgatcacactcctcattctactattggtttcgatatcaccagtccaatctgcaccggtaggcaaagagagggcaatcgagacctatcaagcaagagaaacctacacaggcatatgcctctttgtgttaggaagtgttctctttgcggtatcctggctgacaaaggccttgattgatggcatcggcaacagcttctcccctggactttctgtctgcaagacatgctccattggtagtataaatggatttgaaatagagtctcataaatgctattgcagtctattctgttgtccttactgtagagcttgctcatccgacaaaaacactcaccggatgcacttaaatgtttgcaaaaaaaggaagatgggtagcaatgtcatgctggctgtctgtaaacgtatgtgctttagagcaaccattgaggcaagcaataaggctttactgatcaggagcatcataaattccacttttgtgatttgcatattaatcctaacaatctgtgtggtaagcacctccgcagttgatatggaaaatttgcctgcaggcatctgggagaaagaagaagatcttacaaacttctgtcaccaggagtgtcaagtgacagaaactgaatgcctctgcccgtatgaggccatggtactcaggaagccactcttcctggatagcacagccaagggaatgaaaagcctgttgaactccacgagcttagaaacaagtctgtcaattgaagctccgtggggagcaatcaatgtccagtcaactttcaaaccaacagtttcagctgctaacatagcacttagctggagttcagttgaacacaggggcaacaaaattttagtttcaggtagatcagagtcaatcatgaaattagaagaaagaacaggagtcagctggaatctgggtgtagaagatgcttctgagtcaaagacgcttactgtttccgtcatggacctgtcacaaatgtactctcctgtttttgagtacttgtcaggtgacagacaagtggaggaatggccaaaggcaacttgcacaggtgactgtccagagagatgcggctgcacttcgtcaacctgcttacataaagagtggccacattcaagaaactggcgatgtaatcctacctggtgttggggggtggggactggctgcacttgctgtgggctggatgtaaaggatttttttactgactacatgctggtaaaatggaaagtggaatatataaagacagaagctatagtgtgtgtcgagctgactagtcaagagaggcagtgtagtttaattgaagcaggcacaagatttaacctaggccctgtaacaataaccctatcagagccaagaaatgtccagcagaggcttcctcccgaaattgtaacactgcatcctaaaatagaggaaggtttttttgatttgatgcatgtacaaaaaatactgtctgcaagcacagtttgcaagctacagagctgcacacacggtgtgccgggcgattttcagatctaccatgtcggtaacctgctgaggggagacaaggttaatggacactcaattcacaagatagaaccacattttaatacttcatggatgtcatgggatggttgcgatctggactatttctgcaatatgggggactggccttcatgcacatacactggagtgacacagcataaccgtgctgcatttatcaacatgctcaacattgagactgactatacaaaaactttccactttcattcgaagagggtcacggcacatggagatactccccagctagacctaaaagcgagaccggcatatggtgctggcgaggtcactgttctagtggaggttgcagacttggagttgcacacaaagaaacttgaagtgtcaggtttgaaaattgcaagtttgacctgctctgggtgttatgcctgcagctctggcatctcctgcaaagttagaatccatgtaaatgaaccagatgaatttacagtacatgtaagaagtagcgacccagatgttgtagcagcaggatcaagtcttatggcaaggaaaatagagtttggggctgacagtacattcaaggccttttcatcaatgcccaaggactccttatgcttttacatagtagaaaaggattactgcagcagctgcaccgacgatgacacacaaaagtgtgtcaacacgaagcttgaccatccacagagcatactcattgagcacaaaggaacaataattggcaagcaaaatgacacttgttcgaccaagacaagctgctggctagaatcagttaagggttttttctatgggctaaaaaacatgctaagtggcatctttggaaatgtttttttaggcatcttcttattccttgctccttttgtgctactgatattttttttcttttttgggtggaggcttctgttttgtctcaaatgttgcagaagaactagaggactgttgaaatacaagcaccttaaggatgaagaggaggctggatacaaaaaaatcattgaaaggctaaatggcaaaaaaggtaaaagtcaattgtttgatggtgaaaggcttgcagacaggaagattgctgagcttttttctactaaaattcacataggttaa

SEQ ID NO: 3520 - RNA, 5088 nt, synthetic construct
  misc_feature 1..5088: note = derived and/or modified CDS sequence (wt) from CCHFV(ArD39554)__DQ211628.1__GP
  source 1..5088: mol_type = other RNA
atgttgtgtcatatcaaacacatattattgttttgcattatcctttatcatcaacaatggaacacaggagcttccaatacaactatcagccctacaactaacaaatcccacacagacatatcccatcagccaacatccatcaccgcagcctccagccccgggtcgcccgccaccaccgcgccgcccgaaagatcagtcacaccctcacacactccaaccacctcagtctccgaagccggctccggagagccccctgcggcaactcctgcctcagccaccgcccagagcccagagccagcaagcgcagcccaaccatcaccaaccataccgaaaccaaccacacccgacccgaccagcgaagccctaagcacccccgccaccagcagaccccaagagccaagcacccatccaagccccaggagcagcccaagcaagcctgtagagactcaaagcacacgccacactgcaagagagctcctctcagtaacaggcacggaggcagaacagctcatcacacagacaattcacacgacaaaagaggccacaaaagccaccagcccccagccgaccgccagcaaccccgaccccacactggcaacaaccagccgctccatcaacagcattaaccccaaggggccagagtcaaccagagccacaccccaatccacatccccaacacccgagagttcaacaattcagactcaaattctgccaatcattaccaccccaggcactctggaggcaattattcatccaacaaatagatccaaaagaaaccttggtactgagataatcctgactctcccacaaggtctcaagaaatactacagtaaagtgcttaagctgatgcacctcaccagggaagaagactccgagggtctgcttgagtggtgtacacggatcttgggacaaacctgtgatgatgattactttcaaaagagaataactgaattcttcataacaggtgttggttattttaatgaggttctgctattcaaagaaacgactgatgcacccacattagcaccaactcacaaaggagcaccaccaactgagccttttaagtcttactatgctaagggattcatcacaatggattcgggctacttttctgctaaatgctattcaagagcatcaaactcagggttgcaactaatcaacgtaacaatgcattcatctaagatgcccattactccaggcccaaagtactccaatctcaagaacattaactgtataaacctaaaagtgtcaactgataaagaacacaatgaagttgagataaatgtgcttcttccccaagttgcagtaaatctctcaagctgtcatgtcctggttagatcacatgtctgtgactactcccttgatgcagatggaatgataaagcttccccagataactcacgagggaacttttatacctggaacttataagatcataatagacaaaaagaacaaacaaaatgacagatgtactttgatcaccaactgcgtcataaagggaagagaggtcaggaaggggcagtcggctctcagacagtataagacagagataagagtgggtcaggcatcttctggcactagaagattgttatcagaaagcaacaacaatgattgcgtatcaaggactcagctgatcaagacagaaaatgctgaaatacatggtgatgactatggcgggcccggagagaaaataaccatctgcaacggctctactattgtagaacaaagattaggcagcgaattaggatgctacactatcaacagaataaagtccttcaaactatgcgaaaatagtgcttcaggaaagggttgtgaaattgacagtactccagtaaaatgtaagcaaggcttctgtttgaaaataacccaagaaggaaggggtcatgttaaactttccagaggctcagagataattctagacgtttgcgactcaagctgtgaaatgatgataccaaaagggtctggtgatatcctggtagattgctctggaggacagcagcacttcctacaggacaacttggtcgacttaggatgcccaaacgttcccctactgggcaaaatggccatatacatctgcagaatgtcaaaccaccccaagacaaccatggccttcctcttttggttcagctttggctatgtcataacctgcatcttttgcaaggttatcttttatgtgctaataataattggaacattaggaaaaaggatcaaacagtacagagagcttaagcctcagacctgcactatatgtgaagcaactcctgttaatgcaatagatgctgaaatgcatgatcttaactgtagctacaacatatgcccttattgcgcatctagattaacttcagaaggtctggttaggcatgtgactcagtgtcctaagaggaaggaaaagatagaggaaacagagctgtacttaaatttggaaaggataccctggtttgtcagaaagctcttgcaggtatcagaatcaacaggggtagcgctcaagagaagcagctggctggtgacacttcttgtgttgctaacagtatctttgtcgcctgtgcaatcagcacccattggtcaggaaagaacggtagtaacgtaccaagtcagagaaagttacacaggcatgtgtcttttcatcctaggtagtgtcctttttgcaatctcctggttgacaaagggactggtagacagtgttggtaacattttctttcctggactttcagtttgtaaaacatgttccatcggcagcataaatggctttgaaattgaatcccacaaatgctattgtagccttttctgctgcccttactgtagatactgctcggccgacagaggtgctcaccagtctcatttgagtgtttgtaaaaagaggaaaactggaagcaatgtcatgttagctgtctgcaagcgcatgtgttttagagctactttaaaggtgagcagtgaggctttgattatcaggagcattataaacactacttttgttgtgtgcattctaatattagttgtctgtgttgttagcacctcagccgtagagatggagaacttgccagcaggtacttgggagaaggaagaggacctaacaaacttctgtcaccaagaatgtcaggtaacagaaaccgaatgcctctgtccatacgaggcttttgtgcttagaaagccactttttttggacagtactgccaagagcatgaaaagcctgttaaattcaacaagtttggaaacaagcctgtcaattgaagcaccctggggggcaattaatgtacagtcaactttcaaacccaccgcttcgactgcaaatatagcgctcagttggagctcagtagaacacagaggcaataagattcttgttacaggtagatcagagtcgattatgaaactggaagaaagaacaggaatcagttggaatctcggtgtggaagatgcttctgaatcaaagacactcactgtatcagtcatggacttatctcagatgtattccactgtcttcgagtacttatcaggcgaccggcaagtagaggagtggcctaaagcaacctgcacaggtgattgtccagaaagatgtggctgtacatcatctacttgcctccacaaggcgtggccccattcaaggaactggaggtgcaaccccacgtggtgttggggagttggaactggttgcacttgctgtggattggatgtgaaaaacctctttactgactatatgcttatcaaatggaaagttgaatttataaaaactgaagccatagtgtgtgttgaactcacaagccaggaaaggcaatgcagtcttatagaagcaggcacaagatttaacttgggccctgttaccatcactttatcagaaccaagaaacattcagcagaagctccctcctgaactggttacgctgcatccaagagtagaagaaggcttcttcgaccttatgcatgtgcagaaagtgctttctgcaagcactgtgtgtaaattgcagagctgcacgcatggtgtaccaggtgacttgcaagtgtatcatgtaggcaacttgctgaaaggggataaaataaatggcaactcatttcacaaaattgagccgaacctaaatacatcatggatgtcttgggacggctgtgatcttgattactactgcaacatgggagactggccctcctgtacttacacaggtgtgacgcagcacaaccatgctgcttttgtgaacctgctcaacattgaaactgactatacaaagaacttccactttcactcaaagagagtcacagcacatggagagacgccccagctagaccttaaagccagaccaaagtatggagcaggtgaggtcacagtcctggtggaagttgctgacatggagctgcacactaaaaagattgagatatcaggtttgaaatttgctagcctgacctgcacgggctgctatgcttgtagctcaggtatctcctgcaaggttaggcttcatgtagatgagccagatgagctcacggtacacgtgaagagtgatgatccggatgtagttgcagccagctcaagcctgatggccagaaaaattgaatttggaactgatagcacatttaaagctttctcgtccatgcctaaggataaactctgcttttacattgtggaaagagactactgcagcagttgcagcaaagaggacacacaaaagtgtgtaaatgcaaaacttgagcagcctcagagtatacttattgaacataaaggcaccataattgggaagcaaaatgacacttgtacagtcaaggcgagctgttggttggaatcggtaaaaagttttttttatggactaaaaaacatgttgggtggtatcttcggcaacgttatcttgggcatcatcatgttccttgctccttttgccttgttactgctcttcttccttttcggatggagaattctgttctgccttagatgctgcagaaggactagggggctatttaagtacaaacacatcaaagatgatgaagaatcaggctacaaaaggattattgaaaggttaaataacaagaaaggtaagaacaagttatttgacggcgagagattggcagacaagaaaattgctgaactattctcaacgaagacacacattggctaa

SEQ ID NO: 3521 - RNA, 5088 nt, synthetic construct
  misc_feature 1..5088: note = derived and/or modified CDS sequence (wt) from CCHFV(AP92)__DQ211625.1__GP
  source 1..5088: mol_type = other RNA
atgccggatcacttcatacttctgttgcttatgtacactgttttccatcaacacccacaggatgtcagtgcaaacgtccacctagtcaacccatccaacagcacaacaggtgctagcacagccttcaacccagtgcacaatgcaaccaccgatggtcaaaagcagtctactagcacaacaactatggctcggccaagcacagtgactcagatcactacagcacaagccatggaggtggatggctctggtgagtccaccacactccccgctgtgacccctactccagctgaaacaactacacatgccaatcagaagtcagcttcaaccatgggtacactcaccacgagtctggaggacactgcgctgatgactctgaccggcagaagtatcctaacatcacaatcccaaacaggttcatttgacagaaccagtaagccccaaacaccacgaagcacaaaccaacccctgagaaagctcctctccgcagtaagcaccgaagcagcaccccaaacctcaccaacagcagtcacagcggaccagacagaagcctccaccagcccacaagtcaccactgacacctccccatccactccaacccaggtcacgtcctcagctggcagcagttcgagtaacacatcaaaccactccaagacaacaccccagctaacatcctcaggctcagaggctcaacaaacccagcccaccaccatgccaaacaccacagccctggtcaccccaaccgcacacatcagcccgacaaatagatccaaaaggaactctgaagtggaaataatcctcacactccctcaaggccttaagaaatattacagtaaaatattgaagctgctgcacctcactttagaagaggattctgaaggcttactggagtggtgcactagaacactgaaacaggcatgtgatgacggctacttccaggaaagaataaaggaattctttttgacaggggaaggttattttaacgaagtgctactattcaggtcaccaagtcaactgggcaccaccgggtcacctctcgcaagcccccccacagctgagcccttcaagtctttttatgctaaagggttcttgataatggattcaggttacttctctgctaaatgctatccgaaagcatcaaactccgggctccagctaattaacattacccagcactcaattaaagtagttaacaccccaggaccaaagtattccaacttaaagactgttaactgtataaatttgaaggtgtcaactgacaaggatcacagtgaacttgaagtaaatgtgcttcttcctcaggttgcagttaacatttcaaactgtcatgtccttatcaagtcccatgtttgcgactattccttggatacagacggaatgataaggctaccacaagtcacccatgaaggcacctttataccgggaacctataagatagtgatagataagaagaataaactaaatgacaggtgtaccatgaccaccaactgtgtgatcaaaggaaaagaagttcggaagggacagtcaacccttaggcaatataggacagaaataagggttggtcaaatgtcttctggaacaagaagattgctttcagaagggggtgatggaggctgcatctcaagaactcaactgataaaaacagaaactgcggaggtgcacggagacgattacggtggacctggcgagaaaattaccatctgcaatggttcaaccatcgttgatcagaggttaggtagtgaactggggtgttacacaattaacagaataaaatctttcaaactatgcgagaatagtgcccagggcaagaactgtgagatagacagtgcaccagtacaatgcaggcaaggttattgcttgaaaattagtcaagagggaagaggacatgtgaaactttccaggggttcagaaattgttctagatgtttgtgacacaagctgtgagataatgattcctaagggcacaggtgacatcttagtagactgctcaggagggcagcagcattttctacagagcaacttagttgacctgggttgtccgaacattccgctgctgggcaagatggctatttatatttgcagaatgtcaaatcaccctaaaacaaccatggctttccttttttggttcagctttggctacgtgatcacttgtatattgtgcaagacacttttttacatacttataattattgggacattagggaaaaaattaaagcagtacagagagctgaaaccccaaacatgtaccatatgtgaatcagtaccggttaatgcaatagatgctgaaatgcatgacctcaactgcagctacaacatatgcccttattgtgcctccagactcacctcagaggggctcactagacatgtgaaccagtgccccaaaaggaaagagaaggtagaagagacagagttatacctgaacctggaaaggatcccctggattgttaggaagctcctacaggtatctgagtcaacaggtgtggccttaaaaagaagcagctggatgatcgtgctcctcatattactgatagtctctatgtcaccggttcaatctgcaccaataagtcaggagagaacagttgccctctatcaatccagagaagattatatgggcatttgccttgtcataatggggagtgttcttctggcagtctccttgctggttagggggctgattgacagcattagcagtaccttttttcctggattatctgtttgcaggacatgccatatcggtagcataaatggttttgagattgagtctcataagtgctactgtggcctactgtgctgtccttactgtagggcttgctcaactgaccaggatgcccaccagttccatctaagtgtctgtaagaagagaaaggcaggaagcaacgtcatgttggctgtctgtaagcgtatgtgtttcaaggcaattatcgaagccagcaacaaggtcctattcatcagaaatgtcataaacactacttttgttgtatgcatacttgtgatggtggcctgcatagccagttcggccgctgtagagatggaaaacctaccggcaggaacctgggaacgagaagaagagctcacaaacttctgtcatcaagagtgtcaagtgacagaaactgaatgcctctgtccttatgagtctttcatacttaggaaaccactttttttggatagcatagctaaaggtgttaagaacctcttgaactcaacaagcctggaaactagcttgtcaattgaagcaccatggggggccatcaatgcccaatcaacttacaaaccaactgcatcaagtgctaatattgctctaacatggagctcagtggaacacaggggcaacaagatcttggtctcaggcaggtctgaatcaattatgaaacttgaagagaggaccggaataagctggaacttgggcgttgaagatgcttctgagtcaagaacactcaccatctccgtcatggatctatcacagatgtattcccctgtctttgagtacctgtcaggagatcgtcaggtggaggaatggccaaaggcaacctgcactggcaactgcccggagagatgcggctgcacatcgtcaacctgcctttacaaggagtggccacattcgagaaactggagatgcaaccccacctggtgttggggggttgggactggctgcacatgctgtggactagatgtcaaagaactgttcacggatcacatgctagtaaaatggaaagttgagtacatcaagacagaggccatagtgtgtgttgagcttaccagtcaagaaaggcagtgcagtttgattgaagcaggtacgagatttagcttaggaccagtaacaatcaccttgtctgagccaaggaacattcagcagaagcttcctcctgaattaattacattacacccaaagatagaagacggctactttgacttaatgcatgttcaaaaggttatgtccgccagtacagtgtgcaagctgcaaagttgcacacacggtgtgcccggggacttgcaaatttatcatgttggcaatctgttgaagggggacagagtgaatgggcacctgatccacaaggttgagccacacctgaacacatcctggatgtcgtgggatggttgtgacttagactatttctgcaatatgggggactggccctcctgcacatacaccggggtgacacaacacaatcatgccgcatttgcaaatctgcttaacattgaaaccgactatacaaagactttccatttccactccaaaagagtgacggcccatggagacacaccacagctggacttgaaggcaaggcctaggtatggtgcaggtgaaatcactgttctggttgaagtagctgatatggagttacatacaaagaaggtcgaggtaacaggcttaaaatttgcaagcctaacttgttcaggatgctatgcctgtagttcaggtatctcctgcaaggttagaatacatgtggacgagccagatgagctcacagtgcatgtgaaaagcagcgacccagacattgtggcagccagctcaagtctcatggcaaggaagattgagtttggggttgacagtactttcaaagcgttctcctctatgcctaaagattctctgtgcttttatattgtcgaaagagactattgcaacagctgcaaaaatgaggaaacacagaggtgtgtgaacgcaaagcttgaacagccacagagcatcctcatcgaacatacaggtacaatcattggcaagcagaacgacacctgtggatctaggacaagctgctggctagactcatttaaaagtttcttttatggactaaagagcatgttgagcggcatttttggtaatgtctttctaggcatcttcttgtttcttgccccctttgctctgctgctgtttttctttttctttggatggagaatcctgttttgctttaagtgctgtagaagaaccagaggcctgtttaaatacagacacatcaaggacgatgaagaggttggctacaaaaaaatcatcgaaagactgaacaataaaaaaggcaaacacagacttcttgacggcgagagacttgcagataggaagatcgctgaacttttctcaactaagacacacattggataa

SEQ ID NO: 3522 - RNA, 5085 nt, synthetic construct
  misc_feature 1..5085: note = derived and/or modified CDS sequence (wt) from CCHFV(UCCR4413)__KY484038.1__GP
  source 1..5085: mol_type = other RNA
atgttacgctatattctgtatgcactgttggcaagtgccattctacatcaacacttatataaagttggtgcagacacccaaaagccaacagtgcgcacaaacacaactcataaaataagcccaacagccaccgctaaccgcacaacctatgaacaggcaacacccagcactacaccaaagtcttctacaaagccaaccacccatatagcaacagcacaccttgcagagtctgacggctctggtgagaccaccctcctcctcccgaccactgcctcacagtacacaactgaaggtcaaacctctttagaacccacagcagaggagaccggttcaaacaccatcccaagtgacaccacatccacatcccccatcactgaaaacagtgaaagcacagacacacagatgaatgtctcagatagctccagcagccctctagcaacacaaggcgcgaggtctcccgcaaggaacctcctctccgtgccaagcgtggagccaggacagcagacaacaccaaaacagcccaccacaaaggggaccgtgacccccaccaccccccaaccaacaaccagcagcccaaccccagccccaacatcagccactctatcaacaaacagcagttccatcagtactccagtacagactagttcccctctccaacccatggcccccagtcatgaaactcagcatgccctttacaccacctcaacagaaagcacactcagaacgctctcagctgaacgcatccatccaacgaacagatccagaagaaattctgaggttgaaataattttgactcttcctcagggccttaaaaaatattacagtagattgctaaagttgcttcatctcacaatggaggaagacactgagggtttgcaagagtggtgtgtgcgtgtcttaggccagacctgtgatgacagctactttcataaaaggttggcagagttctttataaccggaacaggtttcttcaatgaggtattactgttcagatcgccaagtacaccaactaccatcaagccgtctcccacgggatcacccacagttgagcccttcaggtcatactatgccaaaggatctcttacaattgattcaggttacttttcagctaagtgttatccacgaacatcaaactcagggctgcaattgataaatttgacacagcattcagttgagattgctaacactcctggccccaaacactcaagtctcaagaccatcaactgtatcaacattaaagcctcaactgacaaagaacataatgaagttgaaataaatgtgctccttccccaagttgcaatcaacctttctaattgtcatgtctctattaggtcacatgtctgtgattactccttagacactgatggaaagataagacttccacaaatttcccacgaagggacatttataccaggaacttacaagatcataatagataagaagaataaattgaatgatagatgctccttgatcactagctgtgtcataaaggggagagagttaagaaaaggacaatcaactttaagacagtataagacagagataaaaattggtcaaacatcctctggctcgaggaggctactttcagaaagcagcgctagtggttgcatttcaaggacccagatgatcaagtcagaaacagcagagatccacgacgacatctacggaggacctggtgagaagcttaccatctgtaatggtaccactgttgtagatcaaagactgggcagtgaactaggttgctacacaatcaacagaattaagacctataaattgtgtgaaaacagtgtcaaagaaaaaacttgtgagattgacagtgtaccagtcaagtgtagacaggggctttgtttgaagataactcaagaaggaagaggccatgttaagctttccagaggctcagagattgtcctggacatttgtgactctagttgtgaattgatgatacctaaaggcactggggacatattggtagattgttctggaggacagcaacattttttacaggataacctggttgacttaggttgccctaacatccccctacttgggaaagtggctatctacatatgcagaatgtcaaatcaccccaagactaccatggcatttctcttctggttcagttttggttatgtgatcacatgcatattgtgcaaaatactcttttacctactcataatcactggcacactagggaaaaaactaaagcagtatagagagctcaagccacaaacatgtaccatatgtgaatcaacacctgtgaatgcaatagatgctgagatgcatgacctcaactgtagttacaacatatgcccttattgtgcatctagactgacttcagatgggctcataaggcatgtgaatctgtgccccaagaggaaggagaaagttgaagagacagaactgtatttgaacttagaaagaataccttggtttgtgagaaagcttttacaggtgtctgaatctacaggagtagctctcaaaagaagcagttggctattgatacttgttatattgctcacagtttctatgtcaccagttcagtcggcaccaattaatcaacaaagagcagttgaagcctaccaggctagggagggctacacaggcatctgcctctttatattagggagtgtcctatttatgacctcttggctaacaaaaggattgattgacagtattggcgacagtttcttccctgggctctttgtgtgcaaaacatgctccataggcagcatcaatggctttgaaatagaatcccataggtgttactgcagcttgctctgctgtccatactgtagaacctgctctgctgacaaagacagccatcagctgcatctaagtatttgtaaaaagaaaaaagcaggaagtaatgtcatgctagcagtgtgtaagcgtatgtgcttcaaggcaacaattgaagcaagcaatagggtgctactgattagaagtatcataaacactacattcattatatgcatgctaattttagtagtgtgtgtcataagcacttctgcagtcgaaatggaagatctaccggcaggcacttgggagagagaagaagacctcaccaacttctgccaccaagaatgccaagtaacagagactgagtgtttgtgcccttatgaagcttttgtgcttagaaaaccactcttcctgagtagtatagtcaagggtaagaagaatctgctaaactcagcaagtttagaaacaagcctgtcaattgaggcaccatggggagccataaatgctcagtccacctttaaacccaccatatcaactgcaaatatagcactcagctggagctcagtggagcatagaggcaataaagttttggtttcaggtagatcagagtctatcatgaaactcgaggagcgaacaggaatcagttggaacctaggggtagaggacgcatcagagtcaagaatgctaacggtctctgtcatggacttgtcacagatgtacttaccagtatttgaatatctgtctggtgacaggcaagtggaagagtggccaaaagcaacctgtacaggtgactgtccagaaagatgcggctgcacatcatcaacctgcttgcataaagaatggccgcactcaagaaactggagatgcaatcccacttggtgttggggggttggaacaggatgcacatgctgcggattagacgtgaaagacctgttcactgattatatgtttgttaagtggaaggttgagtatattaagactgaagccatagtttgtgttgagttaaccagccaagagagacagtgcagcttaattgaggccggcacaagattcaacttaggtcccgtgacaataacattatcagaaccaaggaacatccaacaaaagctcccttcagagatagtcacactgcatcccaaaatagaagaaggcttctttgacctcatgcatgtgcaaaaggtactatctgctagcacggtgtgcaagctgcagagctgcacgcacggagtggcgggagacctgcaggtctatcatgttggcaatttattaaaaggggacaaaataaatggacattcgattcacaagattgaaccacatctcaacacatcatggatgtcttgggatggctgtgatctagactattactgcaatatgggagattggccctcttgcacatacacaggggtgacacaacacaatcatgcagcatttgtcaacctactaaacattgaaactgattacaccaaaagcttccactttcactcaaaaagagtaacagcacatggagacactccccaactggacctgaaggcgcggcccatgtatggtgcaggcgaaataactgtcttggtggaggttgctgacatggaattgcactcaaagaacattgagatctcaggtctaaaatttgcaagcttgacctgctcaggctgttatgcctgcagctcaggtatttcatgcaaagtcagaatccatgtagacgagcccgatgagctagcagtacatgtaaagagtgatgatctggatgttgtggcagctagttcaagtcttatggcaagaaaaatagaattcggaacagatagcacatttaaagctttctcatctatgccaaaagaatctttatgcttctacattgttgaaagagacttctgtaaaagttgtgcagcagaagacacacaaaaatgtgtgaaagcaaaacttgaacagccacaaagcatacttattgaacacaaagggacaataattgggaaacaaaatgacacttgctcaaccaaaacaagctgttggttggagtcattcaaaagcttcttttatgggctaaaaaacatgctaagcggcgtttttggcagtgctattatgggcattctcttgttccttgccccctttatcttgttaatacttttcttcttttttggatggagaatcttattctgcctaagatgttgtagaaggaccagagggctgtttaagtacaagcatatcaaggatgatgaggaagcaggctacaaaaaaatcattgagaagcttaacaacaaaaaagggggaacaagtaaattgttagatggtgagagacttgcggacagaaagattgccgaacttttctcaacaaaagcacacatcggctaa

SEQ ID NO: 3523 - RNA, 5076 nt, synthetic construct
  misc_feature 1..5076: note = derived and/or modified CDS sequence (wt) from CCHFV(SCT ex Afghanistan)__KC344856.1__GP
  source 1..5076: mol_type = other RNA
atgcatcatgcctaccaaattatgtatacactgctagtgtgtgctattctttgtccacagccgtggagtttggaagggacccatgttccgcttaacgggactaaacacaacggaactggcatcacagcagcacctggagggagtcaaggccccacgtcgcctgcaagcacagcagtatccctcacaccggaccccttcaccaccgaacccacagcatcagctgtcgaactggaaagctcgggagaagggcacacctccctctcagtcactacacaaggtctgacctcgccggaaaccacgccagggctcccaacagtaaccgacacaggagtgtctagcacaagcatcttcggcatcggcatacgggtggctggggacactcccacatcgacaacccacacaggtctgcccagcagtcccagcatgccatccacagcacagggcccacatcatgcagtaaggggtttactgtcggtttccagcaccaggccaggagaggcatcaacaataacagtcccaggagaagcaggcacagaggccaacagctcaagctcagccattagcaaaaaaccagccccttcaccaacagctgaagccatcactgaagccaacaactccagcaaccccagacaaccagagctctcaacacaaccagcaatcccaggcctagtgacctcttcagcgcagccaatcctcctacagagtgctacttccacagctgctcaagacatataccccagcccaacaaacagatctaaaagaaaccttgagatggaaataattttgactttatctcaaggtctaaagaagtactacggtaaaatactaagaattttggatctcaccttagaagaagacactgaaggcctgctagagtggtgtaagagaaatcttggtctgacctgtaatgataatttcttccaagagagaatagaagagttttttctgaccggtgaaggccactttaatgaagttttgcagtttaaaacaccaagcacactaagccccacagaaccaactcacaccagaacaccaacagttaaaccctttaaatcttattttgccagaggcttcctttcaatagactcaggctacttctctgccaagtgctattcaaagacctctaattcaggacttcagttgatcaatatcacccagcatccagctagaatagcggacacacctggacctaagatcactaatctaaaggctatcaattgtataaacttaaaggcatcagtcttcaaggagcatagggagattgagatcaatgtgcttctcccacaagtcgcggtcaacctctcaaactgccatgtcttgattaaatcacatgtctgtgattactctttagacattgatggggcagtaagactacctcatgtccaccacaaaggaacattcataccaggaacttataaaatagtaatagataaaagaaacaagcaaaatgacaggtgcaccttggtcactaattgtgtgattaaaggaaaggagattcgtaaaggccagtcagcactaaggcaatacagaacagaaatcagaataggcaaggcatctgccgggtctagaagattgctgtctgaagagtctggtgacgactgtatatcgaggactcagctattgaggacagagactgcagaggtccataatgataactatggtggtccaggtgacaaaattaccatctgcaacggttcaaccattgtagatcagagacttggcagtgaactggggtgttatactatcaacagagtgaagtcattcaagctatgcgaaaatagcgccacgggaaagtcctgtaaaatagacagcaccccggttaagtgcaggcaaggtttttgcttaaaaatcactcaggaaggaaggggccatgtgaagctatcgagaggctcagaagttgtcttagatgcctgcgattcaagctgtgaaataatgataccgaagggcactggagacatcctagtggactgttcaggtgggcagcaacatttcttaaaagataatttgattgatctaggatgccctaacattccactattaggtaaaatggctatctatatttgtagaatgtcaaatcatcccaaaacaactatggcttttctcttttggttcagttttggttatgtaataacatgtatattttgcaaagtcattttttatttattgatagttgtggggacattgggaaaaaagttcaaacagtatcgagagctgaaacctcagacttgtacaatatgtgaaacaactcctaccaatgcaatagatgctgaaatgcacgatcttaactgcagttacaatatatgtccttattgtgcatctagattaacctcggacgggcttgccaggcatgtgacacaatgccctaagcgaaaggaaaaagtagaagagactgagttgtacttgaacttggaaagaattccttggattgtcagaaaactactgcaggtgtcagagtctacaggtgtggcactgaagaggagcagttggctaattgtgttacttgtgctacttacagtttcattgtcaccggttcaatcggcacccatcgggcatggaaagacaattgagacatatcagaccagagaggggtatataagtgtttgcctgtttgtgctagggggcatactgtttgtagtctcctgcctgatcaaaggactggttgacagtgtcggcaacagtttttttcctgggttatctatttgcaagacatgttctatcggcagtgtaaatggctttgaaattgaatcccataaatgttactgtagcttactttgttgcccttattgtagacactgctctactgatagggagatccaccaattgcacttgagcatctgcaaaaaaagaaggacagggggcaatgtcatgttggctgtctgcaagcgcatgtgcttcagagcaactatggaagtaagcaacaaggtcctatttatccgaaacatcatcaataccacctttgttatatgcatactgatattagcagtctgtgtcgttagcacctctgcagtagagatggaaagcctacccgccggcacttgggaaagggaagaagacctaacaaacttctgccaccaagaatgccaagtcacagagactgaatgtctctgtccttacgaagctcttgtactcaggaaaccccttttcttaaacagtatagtcaagggcatgaaaaacctgctaaattcaactaacttggaaacaagcttatcaatcgaagcaccatggggagcaataaatgtccagtcaacctttaaacccactgtatcaactgcaaacatagcactcagctggagttcagtggaacacagaggtaataaaattctagtctcaggcagatcagagtcaattatgaagctagaagaaaggacaggaatcagctgggatttgggcgtagaagatgcctctgagtctaaatcgcttactgtttctgtcatggatttatcacagatgtattctcctgtcttcgagtatctgtcaggtgacagacaggtagaggagtggcctaaagcaacctgcacaggcgattgcccggagagatgtggctgcacatcatcaacctgcttacacaaggaatggccccattcaaggaattggagatgcaaccccacttggtgttggggagtcggcactggatgcacctgctgtgggctagatgtgaaagaccttttcacagattatatgtttgtcaagtggaaggttgaatacataaagacagaggccatagtgtgtgttgagctcactagccaagaaaggcagtgcagcttgattgaggcaggaacaaggttcaacttaggtcctgtgaccatcacgttgtcagagccaagaaacattcagcagaagcttcctcctgaaataatcacattgcatcctagaattgaggaaggctttttcgatctaatgcatgtacaaaaggtgctgtctgcaagtacagtgtgcaagctgcaaagctgcacacatggtgttccaggagacttgcaggtctaccacattggcaacttgttaaaaggggataagttaaacgggcatatgattcacaaaattgagccacacttcaatacctcttggatgtcctgggatggctgtgacctagactattactgtaatatgggggattggccctcttgcacatacactggggtgacccaacataaccatgctgcttttgttaacttacttaacatcgaaactgattacacaaagaacttccactttcactctaaaagagttactgcacatggagacacaccacaattggacttgaaagctagaccaacttacggtgcgggtgaaatcactgtactagtggaagttgctgacatggagttacacacaaaaaagattgatatatcaggtttgaaatttgcaagtctaacttgcgcgggttgctatgcttgtagctctggcatctcctgtaaagtcaggattcatgtagatgaacctgatgagcttacagtacatgtgaaaagtgaagatccggacattgttgcagctagcacaagcctcattgcaaggaagctcgaacttgggacagacagcacattcaaggccttctcagccatgcccaaaacctccttgtgcttctacattgtggagagagaatactgtaagagctgcagcaaagaggacacacagaaatgtgttaacacaaagcttgagcacccacaaggcattttaattgagcacaaaggaacaataatcggaaagcaaaatgacacctgcacagccaaagcaggctgctggttggagtcagtcaagagttttttttatggattgaagaacatgcttagtggcatcttcggcaacgtttttataggtattttcttattccttgctccttttgttctattgatactcttctttatgtttgggtggagactcctgttttgctttaagtgttgtagaagaaccagaggtttattcaagtacagacatctcaaggaagatgaagaatctggttatagaagaatcattgaaagattaaacaacaaaaaaggaaagaacaagctgcttgatggtgaaagactagctgatagaaggatcgctgagctgttctccacaaaaacacatattggttaa

SEQ ID NO: 3524 - RNA, 5070 nt, synthetic construct
  misc_feature 1..5070: note = derived and/or modified CDS sequence (wt) from CCHFV(SPU 431/85)__KJ682812.1__GP
  source 1..5070: mol_type = other RNA
atgcccgtcaacattatgtacacaccactagtgtgtgctgttatctgcctacagctgtggaatctaggaggtactcttgtgtccaccaacaggacccaacacaatgaaacaggcaccgtggcaacacccgaaggaaccctgagacctaggctgcctgtgagcacagcactgcccaccaagtcggaccgcccttctgtcggacccgcagcatcgtccagtggactagagggctcaggggaaccgaatacctccccctcaatcaccacaaaaggcctgaccccgccagagaccacgccagcactccccacagcaaccgacacagatgcatcaagcacaggggtcgtcgatgtcagcacgcagatgaccaaggacatccctatgtcgacggcctacacgaatccacccagcacccctagcgcaccatctacaccacaaggcacacatcacactgcaaggggcctactgtcagtcgctagtacgaagtcagaagaagtatcaatgtcaacaagcccagcaaaaacaagcacagagaccagcagcccacccccagccaccagcgagacaccaaccccctctccaacaactcaggtccccaccggaaacaataaccctaacacctccagacaacctacgccctcagcacagccagcaatgtcaaacccagcaacttctccagcacagccaaacctttcacagagtgccccccccactgctgatcaaggcgtacaccccagcccaacaaacagatccaagaggaaccttgaaatagaaataattttaactttatctcaaggtctgagaaagtactatggcaagatactgaagcttctggaccttaccttagaagaggacactgaaggcctgctagaatggtgtaaaagaaatcttggtctaacctgtgatgataacttctttcagaagagaatagaagagttttttttgactggtgagggttacttcaatgaagtcttacagttcaaggtaccaagcacactgagctccacagagccgactcataccaggccaccaacagttgaacccttcaaatcctacttcgctaaaggcttcctttcaatgaactcaggctacttctctgccaaatgttatccaaggacatctaactcgggacttcagttgatcaatgtcaccaaacattcagctaaaatagcagacacacctggacccaagattactaatttgaagaccatcaattgcataaacttaagggcatcagtcttcaaagaacatagagaggttgagatcaatgtacttctccctcaagttgcagtcaacctctcaaactgccacgcacaaattaaatcgcatgtctgtgactactctttagccactgatgggatggtgagattacctcatatccaccatgaagggactttcataccaggaacttacaaaatagtgatagacaaaaaaaacaagcaaaacgataggtgtaccttggtcacaaattgtgttataaagggaagggaagttcgtaagggccagtctgcattaagacaatacaagacagaaattaggattggcaaggcatcttctggttccagaagactgctgtccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtcatggaaagacaattgaaacatatcaggccagagaagggtacacaagcttctgcctttttatactaggaagcatcttgtttgtagtctcttgcctagtaaagggtctaattgacagtgtcggtaacagctttttccctggattgtccatttgcaagacatgctcgattggcagtataaatggttttgagattgaatcccacaaatgttactgtagtctattttgttgcccttattgtagacactgccctgccgatagagaaatccataagttgcacttgagcatctgcaaaaaaagaaaaactgggagcaatgtcatgttggccgtctgcaagcgcatgtgctttagagcaaccatagaagttagcaatagggctctacttatccggaatatcatcaatactacttttgttgtgtgtatactgacactagcagtttgtgttgtcagcacctctgcagtggagatggaaagtctaccagccggcacttgggagaaagaggaagacctaacaaacttctgtcatcaggaatgccaagtcactgagactgaatgcctctgtccttacgaagcccttgtactcagaaaacccttatttttagacagtattgttaaaggcaggaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggctaa

SEQ ID NO: 3525 - RNA, 5070 nt, synthetic construct
  misc_feature 1..5070: note = derived and/or modified CDS sequence (wt) from CCHFV(SPU 556/87)__KJ682811.1__GP
  source 1..5070: mol_type = other RNA
atgaccgtcaacactgtgtgcacaccactagtgtgtgctgttttctgcctacagctgtggaatctaggaggtactcttgtgcccactaacaggacccaacacaataaaacaggcaccatggcgacacccgaaggaaccctgggacccaggctgcctgtaagcacagcactgcccaccaagtcggaccgcccctctgtcggacccgcagcaccgtccagtggactagagggctcaggggaaccgaatacttccccctcaatcaccacaaaaggcctggccctgccagagaccacgccagcaccccccacagcaaccgacacagatgcatcaagcacaggggtcgtcaatgtcagcacgcagatgaccaaggacatccctatgtcgacggcctacacgaatccacccagcacccctagcgcaccatctacaccacaaggcacacatcacactgcaaggggcctactgtcagtcgccagtacgaagtcagaagaagtatcaatgtcaacaagcccaggaaaaacaagcacagagaccagcagcccacccccagccaccagcgagacaccagccccctctccaacaactcaggctcccaccggaaacaataaccctaacacctccagacaacctacgccctcagcacagccagcaatgtcaaacccaacaacctctccagcacagccaaaccttttacagaatgccccccccactgctgatcaaggcgtacaccccggcccaacaaacagatccaagaggaaccttgaaatggaaataattttaactttatctcaaggtttgagaaagtactacggcaagatactgaagtttctggaccttaccttagaagaggacactgaaggcctgctagaatggtgtaaaagaaatctcggtctaacctgtgatgataacttctttcagaagagaatagaagagttttttttgactggtgagggttacttcaatgaagtcttacagttcaaggtaccaagcacactgagctccacagagccgacccataccgggtcaccaacagttgaacccttcaaatcttacttcgctaaaggcttcctttcaatgaactcaggctacttctctgctaaatgttatccaaggacatccaactcgggacttcagttgatcaatgtcaccaaacattcagctaaaatagcagacacacctggacccaagattactaatttgaagaccatcaattgcataaacttaagggcatcagtcttcaaagaacatagagaggttgagatcaatgtacttctccctcaagtcgcagtcaacctctcaaactgccacgcacaaattaaatcgcatgtctgtgactattctttagccactgatgggatggtgagattacctcgtatccaccatgaagggactttcataccaggaacttacaaaatagtgatagacaaaaaaaacaagcaaaacgataggtgtaccttggtcacaaattgtgtgataaagggaagggaagttcgtaagggccagtctgcattaagacaatacaagacagaaatcaggattggcaaggcatcttctggttccagaagactgctgtccgaggagtctgatggtgactgtatatcaagaactcaactattgaggacagagactgcagaaatccacagtgacaactatggtggcccaggtgacaaaataactatctgcaatggttcaactattgtagatcaaagactaggcagtgaactggggtgttatactatcaatagggtaaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcagaaattgtcttggacgcctgcgattcaagctgtgaaataatgataccaaagggcaccggagacatcttagttgactgttcaggtggacaacaacatttcttaaaagataatttgattgatcttggatgtcccaatatcccattattaggcagaatggccatctacatttgcagaatgtccaatcatcctaaaacaaccatggcctttctcttttggtttagctttggttatgtgataacctgtatcctttgtaaggtgatcttttacctattgatagttgcagggacagtagggaaaaagttcaaacagtatagagagttgagacctcagacctgcaccatatgtgaaacaactcctgtcaatgcaatagatgctgaaatgcatgacctcaactgcagttacaatatatgtccttattgcgcatctagattaacctcagatggtcttgccagacatgtaatgcaatgccccaagcggaaggaaaaaatagaggaaactgaattatacttaaacctagaaaggattccctgggttgttaggaaattattgcaagtttcagagtctaccggtgtggcattgaagaggagcagttggctgacagtgctgcttgtgttgcttatagtttcattgtcaccggtgcagtcagcacctattggtcatggaaagacaattgaaacatatcaggccagagaggggtatacaagcttctgcctttttatactaggaagcatcttgtttatagtctcttgcctagtaaagggtctgattgacagtgtcggtaacagcttcttccctggactgtccatttgcaagacatgctctattggcagtgtaaatggttttgagattgaatcccacaaatgttactgtagtctattttgttgcccttattgtagacactgctctgccgatagagaaatccataagttgcacttgagcatctgcaaaaaaagaaaaactgggagcaatgtcatgtcggccgtctgcaagcgcatgtgctttagagcaaccatagaagttagcaatagggctttacttatccggagtatcatcaataccacttttgctgtgtgtatactaacactagcagtttgtgttgtcagcacctctgcagtggagatggaaagtctaccagccggcacctgggagagagaggaagacctaacaaacttctgtcatcaggaatgccaagtcactgagactgaatgcctctgtccttacgaagcccttgtactcagaaaacccttatttttagacagtattgttaaaggcaagaagaacttgctaaactcaacaagcttggaaacaagcttatcaattgaagcaccatggggtgcaataaatgtccaatcaaccttcaaacctactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacagatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtggactagatgtaaaagacctctttacagattacatgtttgtcaagtggaaagttgaatacataaaaacagaggccatagtgtgcgtcgaacttactagccaagaaagacaatgtagcttgattgaagcaggcacaagattcaatttaggtcctgtgactatcacattgtcagagccaagaaacattcagcaaaagctccctccagagataatcacattgcatcctagaattgaagaaggcttttttgacttaatgcatgtgcaaaaagtgctgtcagcaagcacagtgtgcaagctacagagttgcacacatggtgttccaggagacctacaggtctaccacatcggaaacttgttaaaaggagacaaggtaaacgggcatctgattcacaagattgaaccacatttcaacacttcctggatgtcttgggatggctgtgacctagactactactgcaatatgggggactggccttcttgcacatacactggagtaacccaacataaccatgctgcatttgtaaatttgctcaatatcgaaaccgattatacaaaaaactttcattttcactccaagagagttactgcacatggagacacaccacagttagacttgaaggccagaccaacttatggtgcaggggaggtcactgtactagtggaggttgctgacatggagttgcacacaaagaaaattgagatatcaggcttgaagtttgcaagcctatcttgcacaggctgctatgcttgtagctctggtatctcctgtaaggtcaggatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttacattgtggagagagaatactgtaagagctgcagtagagaagacacacaaaaatgtgttaacactaaacttgagcgaccacagagcattttgatcgaacataaaggaacgattattggaaagcaaaacgacacttgcacagctaaagcaagctgctggctagagtcagtcaaaagttttttctacggattaaagagtatgcttagtggcatttttggcaacgttttcatagggattttcttattcattgctccttttgtcctgttaatacttttctttatgtttgggtggaggattctgttctgctttaagtgctgcagaagaaccaggggcctatttaagtacagacacctcaaggacgatgaagaaaccggttacaggaaaatcattgagaggctaaataacaaaaagggaaaaaacaaactacttgatggggaaaggctagctgacaggaaaatcgccgagttattctccacaaaatcacatatcggctaa

SEQ ID NO: 3526 - RNA, 5070 nt, synthetic construct
  misc_feature 1..5070: note = derived and/or modified CDS sequence (wt) from CCHFV(SPU 18/88)__KJ682810.1__GP
  source 1..5070: mol_type = other RNA
atgcccttcaacatcatgtacacaccactattgtgtgctattctttgtttgcagctgtggagcttagaaggaatttatggattgtccaacaaaacccaacacaatgacactagtaccataaaggtgcccgaagagagtcaaaaaaccagtctacccgcgaacacagcatcgcccatcacgtcagacccctcctccgccacatccacagcattagccagtggaccagaaggctcaggggacacgagcacctctccatcagtcaccacacaaggcccgaccctactagaaaccacgccagagccccacacaacaattgacatcgatgaatcaagcacagccatcgctgacatcagcacacagacagtcaaggacatccccacaccaacaacccacaccagtttgcccagcactcccagcgcgccaactataccgcaagaagcacatcacactgcaagaggcctactgtcagtcaccagcacaaaaccaggagaaacatcaacaccaacaagcccaggggaagcaagcacagaggccagcagcccacagccaactatcagcgaaacaccatccccccccccaacaacccaagcacccaccgaaatcaacaaccccaacacatccagacagcccatgccctcaacacaaccagcagctcccaactcagtgacccctccagtacagccaaccttctctcagagtgacgtttccacggttgctcaagatatacaccccagcccaacaaacagatctaaaagaaatcttgaaatggaaataattttgactttatctcaaggtttgaagaagtactacggcaaggtactaaaacttctggatcttactttagaagaagacactgaaggcctgttagagtggtgtaagagaaaccttggtctgacctgcgatgacaacttctttcagaagagaatagaagagttttttttaactggtgaaggtcacttcaatgaagtgttgcagttcaaaacaccaagcacactgagccctacggaaccagctcgtgttgagtcaccgacagtagaaccctttaaatcttactttgctaaaggcttcctctcaatggactcaggttacttctccgccaagtgttacccaaagtcatccaattcaggacttcagctgatcaacgtcacccaacattcaattagaataacagacacacctgggcctaagatcactagtctgaaaaccatcaattgcataaacttgaaggcattagtcttcaaagagcatagggagattgaaatcaatgttctcctccctcaagtcgcggtcaatctctcaaactgccatgtgctgatcaaatctcatgcttgtgattactctttagacatcgacgggccggtaagactgccccgtatccaccatgaaggaacttttataccaggaacttacaaaatagttatagacaaaaaaaacaagcagaacgacagatgcactttggtcactaactgtgtgataaaaggaagggaaattcgcaaaggccagtcagtgttaaggcaatacagaacagaaattaagattggcaaagcatcttctggttctagaagactattgtctgaagagtctaatgatgactgtttatcaaggactcagctattgaggacagaaaatgcggaaattcacagtgacaactatggtggtccaggtgacaagataactatctgcaacggttcaactattgtagatcagagactgggcagtgaactaggatgttacactatcaatagagtgaaatcatttaagctctgtgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgattcaagctgtgaaataatgataccaaagggcactggggacatcctagttgactgttcaggtgggcagcaacatttcctaaaagataacctggttgatctaggatgccccaacatcccactgttaggcaaaatggccatctacatttgtagaatgtcaaatcatcccaagacaactatgggtttccttttttggtttagctttggttatgtgataacctgtatactttgtaaagtaatcttctatctattaatagttgtagggacattagggaaaaagttcaaacagtacagagagttaaaacctcagacctgtaccatatgtgaaacgaatcctgttaatgcaatagatgctgagatgcacgacctcaactgtagttacaatatatgtccttattgtgcatctaggctgacctcagatggtcttgccagacatgtaatgcaatgccccaaacggaaggaaaaaatagaagaaaccgaattatatttaaacttagaaagaatcccctgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactagggagcatcctgtttttggtatcctgcctgatgaaggggttggttgacagtgtcggcaatagtttttcccctggcttgtccatttgtaagacatgttctattggcagtataaacggctttgaaattgaatctcacaaatgttactgtagtctgttttgctgcccctactgtaggcactgctctgccgatatagaaatacataagttgcacttaagcatctgcaagaaaagaaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggtaactgagactgaatgcctctgtccttatgaagctcttgtgctaaggaaacccttgtttttggacagtattgttaaaggcaagaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgttatggacttgtcacaaatgtattctcctgtctttgagtacctatcaggtgatagacaagtggaggaatggcccaaggcaacctgcacaggagattgcccagagagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcaaaagctccctccagaaatagtcacattgcatcctaggattgaagaaggcttctttgacttaatgcatatacaaaaagtgctatcagcaagtacagtatgcaagctacagagttgcacacatggcgtgccaggagacctacagatctaccacattggaaacttgttaaaaggagacaaggtgaacgggcacctgattcacaaaattgaaccacacttcaacacttcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgcagacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggacccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattgggaagcagaacgacacttgtacaggcaaagcaggttgctggttagagtcaatcaagagttttttttatggactaaagaatatgcttagtggcatttttggcaatgttttcatagggattttcttattcctagctccttttatcatgctaatacttttcttcatgtttggatggaggatcctgttctgctttaagtgttgcagaagaactagaggcctatttaagtatagacacctcaaagacgatgaagaaatcggttacaggaaaatcattgagaggctaaaaaacaaaaaagggaaaaacaaactgcttgatggtgaaagactagctgataggaagatcgctgagctgttctctacaaaaacacacattggctaa

SEQ ID NO: 3527 - RNA, 5070 nt, synthetic construct
  misc_feature 1..5070: note = derived and/or modified CDS sequence (wt) from CCHFV(SPU 497/88)__KJ682808.1__GP
  source 1..5070: mol_type = other RNA
atgcccttcaacattatgtacacaccactattgtgtgccattctttgtttgcagctgtggagcttagaaggaatttatggattgtccaacaaaacccaacacaatgacactagtaccataaaggtgcccgaagagagtcaaaaaaccagtctgcccgcgaacatagcatcgcccaccacgtcagaccccccctccgccacatccacagcatcagccagtggaccagaaggctcaggggacacgagcacctctccctcagtcaccacacaaggcccgaccccactagaaatcacgccagagccccacacaacaattgacatcgataaatcaagcacatccatcgctgacatcagcacacggacagtcaaggacatccccacaccaacaacccacaccagtttgcccagcactcccagcgcgccaactataccgcaagaagtacatcacactgcaaggggcctactgtcagtcaccagcacaaaaccagaagaagcatcaacactaacaagcccaggggaagcaagcacagaggccagcagcccacaaccaaccatcagcgagacaccatcccctcccccaacaacccaagctcccaccgaaatcaacaaccccaacacatccagacagcccatgccctcaacacaaccagcagctcccaactcagtgacccctccagtacagccaaccttctctcagagtgacgtttccacggctgctcaagatatacaccccagcccaacaaacagatctaaaagaaatcttgaaatggaaataattttgactttatctcaaggtttgaagaagtactacggcaaggtacttaaacttctggatcttactttagaagaagacactgaaggcctgttagagtggtgtaagagaaaccttggcctaacctgcgatgacaacttctttcagaagagaatagaagagttttttttaactggtgaaggtcacttcaatgaagtgttgcagttcaaaacaccaagcacactaagccctacggaaccagctcgtgttgagtcgccgacagtagaaccctttaaatcttactttgctaaaggcttcctctcaatggactcaggttacttctccgccaagtgttacccaaagtcatccaattcaggacttcagctgatcaatgtcacccaacatttaattaggataacagacacacctgggcctaagatcactaatctgaaaaccatcaattgcataaacttgaaggcattagtcttcaaagagcatagggagattgaaatcaatgttctcctccctcaagtcgcggtcaacctctcaaactgccatgtgctgatcaaatctcatgtttgtgactactctttagacatcgacgggccggtaagactgccccgtatccaccatgaaggaacctttataccaggaacttacaaaatagttatagataaaaaaaccaagcaaaacgacagatgcactttggtcaccaactgtgtgataaaaggaagggaaatccgcaaaggccagtcagtgttaaggcaatacagaacagaaattaaaattggcaaagcatcttctggttctagaagactattgtctgaagagtctaacgatgactgtttatcaaggactcagctattgaggacagagaatgcggaaattcacagtgacaactatggtggtccaggtgacaagataactatctgcaacggttcaactattgtagatcagagactgggcagtgaactagggtgttacaccatcaatagagtgaaatcatttaagctctgcgaaaacagtgctacaggtaaatcttgtgaaatagatagcaccccagtcagatgtaggcagggtttttgcttgaaaattactcaggagggaaagggccacgtgaagctatcaagaggctcagaggttgtcctggacgcctgtgattcaagctgtgaaataatgataccaaagggcacaggggacatcctagttgactgttcaggtgggcagcaacatttcctaaaagataacctggttgatctaggatgccccaacatcccactgttaggcaaaatggccatctacatttgtagaatgtcaaatcatcccaagacaactatggttttccttttttggtttagctttggctatgtgataacctgtatactttgtaaagtaatcttctatctattaatagttgtagggacgttaggaaaaaagttcaaacagtacagagagttaaaacctcagacctgtaccatatgtgaaacaaaccctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactaggaggcatcctgtttttggtatcctgcctgatgaaggggttggttgacagtgtcggcaatagttttttccctggcttgtccatttgtaagacatgctctattggcagtataaacggctttgaaattgaatctcacaaatgttactgtagcctattttgctgcccctactgtagacactgctctgccgatatagaaatacacaagttgcacttgagcatctgcaagaaaaggaaaacttggagtaatgtcatgttagccgtctgtaagcgcatgtgctttagggcaactgtggaagtaagcaataaagctttacttatccgaaacatcatcaacaccactttcgttgtgtgcatactgatattagcaatttgtgttgtcagcacctctgcagtggagatggaaaacctgccagcaggcacttgggaaaaggaggaagacctgacaaatttctgtcatcaggaatgccaggtcactgagactgaatgcctctgtccttatgaagctcttgtactcaggaaacccttgtttttggacagtattgttaaaggcatgaggaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaactgctcactgtctctgttatggacttgtcacaaatgtattctcctgtctttgaatacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggttggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagaaccaaggaacattcagcaaaagctccctccagaaatagtcacattgcatcctaggattgaagaaggcttctttgacttaatgcatatacaaaaagtactatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaacatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataattggaaaacagaacgacacttgtacagccagagcaagttgctggttagagtcaatcaagagttttttttatggactgaagaatatgcttagtggcatttttggcaatgttttcatagggattttcttattcttcgctccttttatcatgctaatacttttctttatgtttggatggaggatcctgttctgctttaagtgttgcagaagaactagaggcttgtttaagtatagacacctcaaagacgatgaagaagtcggttacaggaaaatcattgagaggctaaacaacaaaaaagggaaaaacaaactgcttgacggtgaaagactagctgataggaagatcgctgagctgttctctacaaaaacacacattggctaa

SEQ ID NO: 3528 - RNA, 5070 nt, synthetic construct
  misc_feature 1..5070: note = derived and/or modified CDS sequence (wt) from CCHFV(SPU 130/89)__KJ682807.1__GP
  source 1..5070: mol_type = other RNA
atgcccttcaacatcatgtacacaccactattgtgtgctattctttgtttgcagctgtggagcttagaaggaatttatggattgtccaacaaaacccaacacaatgacaatagtaccacaaaggcgcccgaagagagtcacaaaaccagtctgcccgcgaacacagcatcgcccatcacgtcagatcccccctccaccacatccacaacatcagccagtggtccagaaggctcaggggacacgagcacctctcccccagtcaccacacaaggcccggcctcaccagaaaccacgccagagccccacacaacaattgacatcgataaatcaagcacagccatcgctgacatcagcacacagacagtcaaggacatccccacaccaacaacccacaccagtttgcccagcactctcagcgcgccaactataccgcaagaagcacatcacactgcaaggggcctactgtcagtcaccagacacaaaccaggagaagcatcaaaaccaacaagcccaggggaagcaagcacagaggccagcagctcacaaccaaccatcagcgagacaccatccccccccccaacaacccaagctcccaccgaaatcaacaaccccaacacatccagacagcccatgccctcaacacaaccagcagctcccagctcagtgacccatccagcacagccaaccccatctcagagcgacgtccccacggctgctcaagatatacaccccagcccaacaaacagatctaaaagaaatcttgaaatggaaataatattgactttatctcaaggtttgaagaagtactacggcaaggtactaaaacttctggatcttactttagaagaagacactgaaggcctgttagagtggtgtaagagaaaccttggtctgacctgcgatgacaacttctttcagaagagaatagaagagttttttttaactggtgaaggtcacttcaatgaagtgttgcagttcaaaacaccaagcacgctaagccctacggaacctgctcgtgttgagtcaccgacagtagaaccctttaaatcttactttgctaaaggcttcctctcaatggactcaggttacttctccgccaagtgttacccaaagtcatccaattcaggacttcagctgatcaacgtcacccaacatttaattagaataacagacacacctgggcctaagatcactaatctgaaaaccatcaattgcataaacctgaaggcattagtcttcaaagagcatagggagattgaaatcaatgttctcctccctcaagtcgcggtcaacctctcaaactgccatgtgctgatcaaatctcatgtttgtgactactctttagacatcgacgggccggtaagactgcccagtatccaccatgaaggaacttttataccaggaacttacaaaatagttatagataaaaaaaacaagcagaacgacagatgcactttggtcactaactgtgtaataaaaggaagggaaattcgcaaaggccagtcagtgttgaggcaatacagaacagaaattaagattggcaaggcatcttctggttctagaagactattgtctgaagagcctaattatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagggtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgttcaggtgggcagcaacatttcctaaaagataacctggttgatttaggatgccccaacatcccactgttaggcaaaatggccatctacatttgtagaatgtcaaatcatcccaagacaaccatggctttccttttttggtttagctttggttatgtgataacctgcatactttgtaaagtaatcttctatctattaatagttgtagggacattaggaaaaaagttcaaacagtacagagagttaaaacctcagacctgtaccatatgtgaaacgaatcctgttaatgcaatagatgctgagatgcatgacctcaactgcagttacaatatatgtccttattgtgcatctaggttaacctcagatggtcttgccagacatgtaatgcaatgccccaaacggaaggaaaaaatagaagaaaccgaattatatttgaacttagaaagaatcccttgggttgttaggaaattactgcaggtgtcagaatccaccggtgtagcactaaagaggagtagttggctggttgtactacttgtgctactcacagtttcattgtcaccagtacaatcagcacctatcagccatggagagacagtcgaagtatatcaaaccagagaagggtacacaagtatttgcctttttgtactaggaagcatcctgtttctggtgtcctgcctgatgaaggggttggttgacagtgtcggcaatagttttttccctggcttgtccatttgtaagacatgttctattggcagtataaacggctttgaaattgaatctcacaaatgttactgtagcctattttgctgcccctactgtagacactgctctgccgatatagaaatacataagttgcacttgagcatctgcaagaaaaggaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggtcactgagactgaatgcctctgcccttatgaagctcttgtgctcaggaaacccttgtctttggacagtattgttaaaggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgtacaggagattgcccagaaagatgcggctgcacgtcatcaacctgcctacacaaagaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatacactggcgtaacccaacacaaccatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaagttgagatatcaggtttgaagtttgcaagcttaacttgcacaggctgttatgcttgtagttctggtatctcctgtaaggtcaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaacactgcaaaagctgtagtaaagaagacacacaaagatgtgtcaacacaaagcttgaacaaccacaaagcattttaatcgagcacaaagggacgataattggaaagcagaacgacacttgtacagccaaagcaagttgctggttagagtcaattaagagttttttttatggactaaagaatatgcttagtggcatttttggcaatgttttcataggggttttcttattcctcgctccttttatcatactaatacttttcttcatgtttggatggaggatcctgttctgctttaagtgttgcagaagaactagaggcttacttaagtatagacacctcaaagacgatgaggaaatcggttacaggaaaatcattgagaggctaaacaacaaaaaagggaaaaacaaactgcttgacggtgaaagactagctgataggaagatcgctgagctgttctctacaaaaacacacattggctaa

SEQ ID NO: 3529 - RNA, 5070 nt, synthetic construct
  misc_feature 1..5070: note = derived and/or modified CDS sequence (wt) from CCHFV(SPU 383/87)__KJ682806.1__GP
  source 1..5070: mol_type = other RNA
atgcccttcaacatcatgtacacaccactattgtgtgctattctttgtttgcagctgtggagcttagaaggaatttatggattgtccaacagaacccaacacaatgacactagtaccataaaggtgcccgaagagagtcaaaaaaccagtctgcccgcgaacacagcatcgcccatcacgtcagaccccccctccaccacatccacagcatcagccagtggaccagaaggctcaggggacacgagcacctctcccccagtcaccacacaaggcccgaccccaccagaaaccacgccagagccccacacaacaattgacatcgataaatcaagcacagccatcgctgacatcagcacacagacagtcaaggacatccccacaccaacaacccacaccagtttgcccagcactctcagcgcgccaactataccgcaagaagcacatcacactgcaaggggcctactgtcaattaccagcacaaaaccaggagaagcatcaacaccaataagcccaggggaagcaagcacagaggccagcagcccacaaccaaccatcagcgagacaccatccccccccccaacagcccaagctcccaccgaaatcaacagccccaacacatccagacagcccatgccctcaacacaaccagcagctcccaactcagtgacccatccagcacagccaactccctctcagagcgacgtccccacggctgctcaagatatacaccccaatccaataaacagatctaaaagaaatcttgaaatggaaataattctgactttgtctcaaggtttgaagaagtactacggcaaggtactaaaacttctggatcttactttagaagaagacactgaaggcctgttagagtcgtgtaagagaaaccttggtctgacctgcgatgacaacttctttcagaagagaatagaagagttttttttaactggtgaaggtcacttcaatgaagtgctgcagttcaaaacaccaagcacactaagccctacggaacctgctcgtgttgagtcaccgacagtagaaccctttaaatcttactttgctaaaggcttcctctcaatggactcaggttatttctctgccaagtgttactcaaagtcatccaattcaggacttcagctgatcaacgtcacccaacatttaattagaataacagacacacctgggcctaagatcactaatctgaaaaccatcaattgcataaacttgaaggcattagtcttcaaagagcatagggagattgaaatcaatgttctcctccctcaagtcgcggtcaacctctcaaactgccatgtgctgatcaaatctcatgtttgtgactactctttagacatcgacgggccggtaagactgccccgtatccaccatgaaggaactttcataccaggaacttacaaaatagttatagataaaaacaacaagcagaacgacagatgcactttggtcactaactgtgtgataaaaggaagggaaattcgcaaaggccagtcagtgttaaggcaatacagaacagaaattaagattggcaaggcatcttctggttctagaagactattgtctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttctgcttgaaaattactcaggagggaaggggccacgtgaagctatcaagaggctcagaagttgtcttggacgcctgcgactcaagctgtgaaataatgataccaaagggcactggggacatcctagttgactgttcaggtgggcagcaacatttcctaaaagataacctggttgatttaggatgccccaacatcccactgttaggcaaaatggcaatctacatttgtagaatgtcaaatcatcccaagacaactatggctttccttttttggtttagctttggttatgtgataacctgtatactttgtaaagtaatcttctatctattagtagttgtagggacattagggaaaaagttcaaacagtacagagagttaaaacctcagacctgtaccatatgtgaaacgaatcctgttaatgcaatagatgctgagatgcacgacctcaactgcagttacaatatatgtccttattgtgcatctaggttaacctcagatggtcttgccagacatgtaatacaatgccccaaacggaaggaaaaaatagaagaaaccgaattatatttaaacttggaaagaatcccttgggttgttaggaaattactgcaggtgtcagaatccaccggtgtagcactaaagaggagtagttggctggttatactacttgtgctactcacagtttcattgtcaccagtacaatcagcacctatcagccatggagagacagtcgaagtatatcaaaccagagaagggtacacaagtatttgcctttttgtactaggaagcatcctgtttttggtatcctgcctgatgaaggggttggttgacagtgtcggcaatagctttttccctggcttgtccatttgtaagacatgttctattggcagtataaacggctttgaaattgaatctcacaaatgttactgtagcctattttgctgcccctactgtagacactgctctgccgatatagaaatacataggttgcacttgagcatctgcaagaaaaggaaaactgggagtaatgtcatgttagccgtctgtaagcgcatgtgctttagggcaactgtggaagtaagcaataaagctttacttatccgaaacatcatcaacaccacttttgttgtgtgcatactgatattagcagtttgtgttgtcagcacctctgcagtggagatggaaaacctgccagcaggcacttgggaaaaagaggaagacctgacaaatttctgtcatcaggaatgccaggttactgagactgaatgcctctgtccttatgaagctcttgtgctcaggaaacccttgtttttggacagtattgttaagggcatgaagaacttgctaaattcaacaagcctagaaacaagcttatcaattgaggcaccatggggggcaataaatgtccagtcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaggaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgactatcacattgtcagagccaagaaacattcagcagaagctccctccagaaatagtcacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccatcttgctcatatactggcgtaacccaacacaatcatgctgcatttgtaaacatgctcaacatcgaaactgattatacaaaaaacttccactttcactctaagagagttacagcacatggagacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggtatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgatatttggaaagcagaacgacacttgtacagccaaagcaagttgctggttagagtcagttaagagttttttttatggactaaagaatatgcttagtggcatttttggcaatgttttcataggggttttcttattcctcgctccttttatcatgctaatacttttcttcatgtttggatggaggatcctgttctgctttaagtgttgcagaagaactagaggcttatttaagtatagacacctcaaagacgatgaagaaatcggttacaggaaaatcattgagaggctaaacaacaaaaaagggaaaaacaaactgcttgacggtgaaagactagctgataggaagattgctgagctgttctctacaaaaacacacattggctaa

SEQ ID NO: 3530 - RNA, 5070 nt, synthetic construct
  misc_feature 1..5070: note = derived and/or modified CDS sequence (wt) from CCHFV(SPU 44/08)__KJ682805.1__GP
  source 1..5070: mol_type = other RNA
atgcccttcaacatcatgtacacaccactattgtgtgctattctttgtttgcagctgtggagcttagaaggaatttatggattgtccaacaatacccaacacaatgacactagtaccataaaagtgcccgaggagagtcaaaaaaccagtctgcccgcgaacacagcatcacccatcacgtcagacccccccccgaccacacccacagcatcagccagtggaccagaaggctcaggggacacgagcacctctcccccagtcaccacacaaggcccgaccccaccagaaaccacgccagagccccacacaacaattgacatcgataaatcaagcacagccatcgctgacatcagcacacagacagtcaagaacatccccacaccaacagcccacaccagtttgcccagcactctcagcgcgccaaccatgccgcaagaagcacatcacactgcaaggggcctactgtcagtcaccagcacaaaaccaggagaagcatcaacaccaacaagcccaggggaagcaagcacagaggccagcagcccacaaccaaccatcagagagacaccatccccccctccaacaacccaaactcccaccgaaatcaacaaccccaacacatccagacagcccatgccctcaacacaaccagcagctcccagctcagtgacccatccagcacagccaaccccctctcagagcgacgtccccacggctgctcaagatatacaccccagcccaacaaacagatctaaaagaaatcttgaaatggaaataattttgactttatctcaaggtttgaagaagtactacggcaaggtactaaaacttctggatcttactttagaagaagacactgaaggcctgttagagtggtgtaagagaaaccttggtctgacctgcgatgacaacttctttcagaagagaatagaagagttttttttaactggtgaaggtcacttcaatgaagtgttgcagttcaaaacaccaagcacactaagccctacggaacctgctcgtgttgagtcaccgacagtagaaccctttaaatcttactttgctaaaggcttcctcttaatggactcaggttacttctccgccaagtgttacccaaagtcatccaattcaggacttcagctgattaacgtcacccaacatttaattagaataacagacacacctgggcctaagatcactaatctgaaaaccatcaattgcataaacttgaaggcattagtcttcaaagagcatagggagattgaaatcaatgttctcctccctcaagtcgcggtcaacctctcaaactgccatgtgctgatcaaatctcatgtttgtgactactctatagacatcgacgggccggtaagactgccccgtatccaccatgaaggaacttttataccaggaacttacaaaatagttatagataaaaaaaacaagcagaacgacagatgcactttggtcactaactgtgtgataaaaggaagggaaattcgcaaaggccagtcagtgttaaggcaatacagaacagaaatcaagattggcaaggcatcttctggttctagaagactattgtctgaagagtctaatgatgactgtttatcaaggactcagctattgaggacagagaatgcggaaattcacagtgacaactatggtggtccaggtgacaagataactatctgcaacggttcaactattgtagatcagagattgggcagtgaactagggtgttacactatcaatagagtgaaatcatttaagctctgcgaaaacagtgctacaggtaaatcttgtgaaatagatagcaccccagtcagatgtaggcagggtttttgcttgaaaattactcaggagggaaggggccacgtgaagctatcaagaggctcagaagttgtcttggacgcctgtgactcaagctgtgaaataatgataccaaagggcactggggacatcctagttgactgctcaggtgggcagcaacatttcctaaaagataacctggttgatttaggatgccccaacatcccactgttaggcaaaatggccatctacatttgtagaatgtcaaatcatcccaagacaactatggctttccttttttggtttagctttggttatgtgataacctgtatactttgtaaagcaatcttctatctattaatagttgtagggacattaggaaaaaagttcaaacagtacagagagttaaaacctcagacctgtaccatatgtgaaacaaatcctgttaatgcaatagatgctgagatgcacgacctcaactgcagttacaatatatgtccttattgtgcatctaggttaacctcagatggtcttgccagacatgtaatgcaatgccccaaacggaaggaaaaaatagaagaaaccgaattatatttaaacttagaaagaatcccttgggttgttaggaaattactgcaggtgtcagaatccaccggtgtagcactaaagaggagtagttggctggttatactacttgtgctgctcacagtttcattgtcaccagtacaatcagcacccatcagccatggagagacagtcgaagtatatcaaaccagagaagggtacacaagtatttgcctttttgtactaggaagcatcctgtttttggtatcctgcctgatgagggggttggttgacagtgtcagcaatagctttttccctggcttgtccatttgtaagacatgttctattggcagtataaacggctttgaaattgaatctcacaaatgttactgtagcctattttgctgcccctactgtagacactgctctgccgacatagaaatacataagttgcacttgagcatctgcaagaaaaggaaaactgggagtaatgtcatgttagccgtctgtaagcgcatgtgctttagggcaactgtggaagttagcaataaagctttacttatccgaaacatcatcaacaccacttttgttgtgtgcatactgatattagcagtttgtgttgtcagcacctctgcagtggagatggaaaatctgccagcaggcacttgggaaaaagaggaagacctgacaaatttctgtcatcaggaatgccaagtcactgagactgaatgcctctgtccttatgaagctcttgtgctcaggaaacccttgtttttggacagtattgttaaaggcatgaagaacttgctaaattcaacaagcctagaaacaagcttatcaattgaggcaccatggggggcaataaatgtccaatcaactttcaaaccaactgtgtcagctgcaaacatagcgcttagttggagctcagtagaacatagaggcaataaaattttggtttcaggcagatcagagtcaatcatgaaattagaggaaaggacaggaattagctgggatctgggtgtggaagacgcctctgagtccaaattgctcactgtctctgtaatggacttgtcacaaatgtattctcctgtctttgagtacctatcaggtgatagacaagtggaagaatggcccaaggcaacctgcacaggagattgcccagaaagatgcggctgcacgtcatcaacctgcctacacaaggaatggccccattcaagaaactggagatgcaaccctacttggtgttggggagtcggcactggatgcacctgttgtgggctggatgtgaaagacctctttacagattacatgtttgtcaagtggaaagttgactacattaaaacagaagctatagtgtgtgttgagcttactagccaggaaagacaatgtagcttaattgaggcaggcacaagattcaacttgggtcctgtgaccatcacattgtcagagccaagaaacattcagcagaagctccctccagaaatagttacattgcatcctaggattgaagaaggcttctttgacttaatgcatatacaaaaagtgctatcagcaagtacagtatgtaagctacagagttgcacacatggcgtgccaggagacctacagatctaccacattggaaacttgttaaaaggagacaaggtgaacgggcacctgattcacaaaattgaaccacacttcaacacctcctggatgtcttgggacggctgtgacctagactactactgtaatatgggggattggccgtcttgctcatatactggcgtaacccaacacaatcatgctgcatttgtaaacatgctcaacatcgaaactgattatacaaaaaacttccactttcactctaagagagttacagcacatggggacacaccacaattagatttaaaagctagaccaacttatggtgcaggtgaaatcactgtgctggtagaggttgctgacatggagttgcatacaaagaaaattgagatatcaggtttgaagtttgcaagcttaacttgcacaggctgttatgcttgtagttctggcatctcctgtaaggttaggatccatgtagatgaaccagatgagcttacagtacatgtgaagagcgaggatccagacatagttgctgctagttcaagtctcatggctaggaagcttgaatttgggacagatagcacatttaaagccttttcagccatgcccaaaacctccttgtgcttttacattgtggagagggaatactgcaaaagctgtagtaaagaagacacacaaaaatgtgtcaacacaaagcttgaacaaccacaaagcattttaatcgagcacaaagggacgataatcggaaagcagaacgacacttgtacagccaaagcaagttgctggttagagtcaattaagagttttttttatggactaaagaatatgcttagtggcatttttggcaatgttttcatagggattttcttattcctcgctccttttatcatgctaatacttttcttcatgtttggatggaggatcctgttctgcttcaagtgttgcagaagaactagaggcttatttaagtatagacacctcaaagacgatgaagaaatcggttacaggaaaatcattgagaggctaaacaacaaaaaagggaaaaacaaactacttgacggtgaaagactagctgataggaagatcgctgagctgttctctacaaaaacacacattggctaa

SEQ ID NO: 3531 - RNA, 5070 nt, synthetic construct
  misc_feature 1..5070: note = derived and/or modified CDS sequence (wt) from CCHFV(Matin)__AF467769.2__GP
  source 1..5070: mol_type = other RNA
atgtctttcaacattatgtacacactactgttgtgtgcaattctttgctcacagctgtggagttcagaaggtattcatggactgtccaacgaaacccaacatggtaatgcaagcaccataaaggcgcccgaagtgagccaaggacttggattgcctgtgagcacagcaccacccattacgtcagaccctccctccatcacatctgcagcgtcagtcagtggaccagaaggttcaggagacacgaacacctctcctccggtcaccacacaaggcttgactttgccagaaaccacactggaactcctcacaacaaccaacacaggtgcatcaagcacagtcatcgtcgatgtcagcacacagacggtcaaggacacccccgtgtcaacagcccacacaagcccgcccggcacccccagcgcgccaaccacaccacagggcacacatcacactgcaaggggtctactgtcagtcaccagcacaaagtcagaagaagcatcaacacaaacaaatccaaaaaaaacaagcatggagaccaacagcccgggcccagccaccagcgaaacaccatccccctctccaacaacccaggcccccaccgaaaacaacaaccccaatacacccaggcagcccacgcccccgacacaaccagcaaccccaagcccagtgacctctccagcactgctagcctcctctcagggtgacacgtctacggctgttcaagatgtacatcccagcccaacaaacagatctaagagaaaccttgagatggagataattttgactttatctcaaggtttgaagaagtactatggcaagatactaaaacttctggaccttactttggaggaagacactgaaggcctgttagagtggtgtaagagaaatcttggtttggtctgtgatgacagcttctttcagaagaggatagaagagttttttttgaccggtgaaggtcacttcaatgaagtcttacagtttaaaacaccaagcacactaagccccacggaaccagctcgagctgggtcaccaacagttgaacccttcaaatcttatttcgccagaggcctcctttcaatggactcaggttacttctctgccaagtgttatccaagagcatccaattcaggacttcagttgatcaacatcacccaacattcagctagaataacagacacacctggacccaagatcactaatctaaaaaccatcaattgcataaacttaaaggcatcaaccttcaaagagcatagagagattgaaatcaatgttcttctccctcaagtcgcagtcaacctctcaagctgccacgtactgatcaaatcgcatgtctgtgactactctttggacattgacgggccagtgagactacctcgtatccaccatgaaggtactttcataccaggaacttacaaaatagttatagacaaaaaaaacaaacagaacgacaggtgcactatagtcaccaactgtgtaataaaaggaagggaaattcgtaagggtcagtcggtgttaagacaatacaagacagaaatcaagattggcaaggcatcttctggttccagaagactgttgtccgaagagtctggtgatgactgtatatcaagaactcagctattgaggacagagactgcggaaattcacagtgatagctatggtggaccaggtgataagataaccatctgcaatggttcaactgttgtagatcagaggttgggcagtgaactagggtgttacactataaatagagtaaagtcatttaagctttgcgagaacagtgccacaggtaaatcctgtgaaatagatagcaccccagttaaatgcaggcagggtttttgcttaaaaattactcaggagggaaggggccacgtgaagctgtcgagaggttcagaagttgtcttggatgcctgtgactcaagctgtgaaataatgataccaaagggcactggagacatcctagttgactgttcaggtgggcagcaacatttcttaaaagataacctgattgatctgggatgccccaacattccactattaggcaaaatggccatctacatttgtagaatgtcaaatcatcccaaaacaactatggtttttcttttttggtttagctttggttatgtaataacctgtatactctgtaaggtcatcttctatctattaatagttgtagggacattagggaaaaagttcaaacagtatagagagttgaaacctcagacctgtaccatatgcgaaacaactcctgttaatgcaatagatgctgaaatgcacgaccttaactgcagttacaatatatgtccttactgtgcatccaggttgacatcagatggtcttgccagacatgtaatgcagtgccccaaacggaaggaaaaaatagaagaaaccgaattatacttaaacttagaaaggatcccttgggttgttaggaaattactgcaggtgtcagaatctaccggtgtggcactaaagaggagtagctggctggttgtgctacttgtgttacttacagtttcactatcaccagtacaatcagcacctatcggccatggaaagacagttgaaacatatcagatcagagaagggtacacaagtgtttgcctttttgtactagggagcatcttgtttatagtctcttgcctaatgaaagggctggttgacagtgacggtaacagttttttccctggtttgtccatttgcaagacatgttctattggcagtataaatggctttgaaattgaatctcacaaatgttactgtagcctattttgttgcccctactgtagacactgctctacagatagagaaatacataaattgcacttgagcatctgcaagaaaaggaaaactggaagtaatgtcatgttggccgtctgtaagcgcatgtgctttagggcaactgtagaagtaagcaacaaggctctactaatccgaagcatcatcaacaccacttttgttgtgtgtatactgatattagcagtttgtgttgtcagtacctccgcagtggagatggaaagcctgccagctggcacttgggagagagaagaagacctgataaatttctgtcatcaggaatgccaagtcactgagactgaatgtctctgtccttacgaagctcttgtgctcagaaaacccttgtttttagacagtattattaagggtatgaagaacttgctaaattcaacaagcttagaaacaagcttatcaattgaggcaccatggggagcaataaatgtccaatcaactttcaaacctactatgtcagctgcgaacatagcgctaagttggagctcagtggaacacagaggtaataagattttggtttcaggcagatcagagtcgatcatgaagctagaggaaaggacaggaatcagctgggatctaggagtagaagatgcctctgagtctaaattgcttactgtatctgttatggacttatcacagatgtattctcctgtctttgagtacttatcaggtgatagacaagtggaggaatggcccaaggcaacctgcacaggcgattgtccagaaagatgtggctgcacatcatcaacctgcctacacaaagaatggccccattcaagaaactggagatgcaatcctacttggtgttggggagtcggcactggatgtacctgctgtgggctagacgtaaaagacctttttactgattacatgtttgtcaagtggaaagttgaatacattaaaacggaagttatagtgtgtgttgagcttactagccaagaaagacaatgtagcttgattgaggcaggcacaagattcaacttaggtcctgtgaccattacattgtcagagccaagaaacattcagcaaaagctccctccagagatagtcacattgcatcccagaattgaagaaggtttctttgatttaatgcatgtacaaaaagtgctatcagcaagtacagtgtgcaagctacagagttgcacacatggtgtgccaggggacctacaggtctaccacataggaaacttgttaaaaggagataaggtgaacgggcacttgattcacaaaattgaaccacacttcaacacttcctggatgtcttgggacggctgtgacctagactactactgtaatatgggggattggccatcttgctcatatactggagtaacccaacacaatcatgctgcatttgtaaacatgctcagcatcgaaactgattatacaaaaaacttccactttcactctaagagagttactgcacatggagacacaccacaattagatctgaaagctaggccaacttacggtgcaggtgaaatcactgtgctggtagaggttgctgacatggaattacatacaaagaaaattgagatatcaggtttgaagtttgcaagcttaacttgcacaggatgttatgcttgtagctctggtatctcctgtaaggttagaatccatgtagatgaaccagatgagcttacagtacatgtgaagagtgaagacccagacatagttgctgctagctcaagtctcatggctagaaagcttgaatttgggacagatagtacattcaaagccttttcagccatgcccaaaacctccttatgcttttacattgtggagagagaatattgtaaaagttgcagtaaagaagacacacaaaaatgtgtcaacacaaagcttgagcaaccacagagcatcttaatcgagcataaagggacgataattggaaagcaaaacgacacctgtacagccaaagcaagctgctggctggagtcagtcaaaagttttttttatggactaaagaacatgcttagtggcatttttggcaatgttttcatagggattttcttattccttgctccttttgcccttttaatacttttctttatgtttggatggagaatcctgttctgctttaaatgttgcagaagaactagaggcctatttaaatacagacacctcaaggacgacgaagaaaccggttacaggaaaatcattgagaggctgaacaacaaaaaaggtaaaaacaaactgctcgacggtgaaagactagctgacaggaagatcgctgagctgttctccacaaaaacacacgttggctaa

SEQ ID NO: 3532 - RNA, 5070 nt, synthetic construct
  misc_feature 1..5070: note = derived and/or modified CDS sequence (wt) from CCHFV(TADJ/HU8966)__AY179962.1__GP
  source 1..5070: mol_type = other RNA
atgcctgttagcattatgcatatgttattgatgtgtgcagtactttgcttgcagctatatggtctggggggaactcttagatcaaacaacggaaccgaacacaacaaaacaaatgttttgacaacgcccggcgacaaactgagccctgagccgccagtaagcacagccttgcctgttacgccagactcctccactgtcacacccacaacaccagccagtggactggaaggctcgggggaagtgtacacatcccccccaatcaccaccaagggcctgtctccgtcggaggctacgtcagagccccccgcgacaactggtatgggcatctcaagtgcaagtggtgtcgatttcagcacacaggcagccagagacacctcaacactaacagttctcacaagtccacctaacagccctaacacaccacctacatcacaagacacgcaccatcctgtgaggagtctactttcagtcacgagccccaggccagaagagacaacagcaccgtcaaaatcaggcaaagagagtccagcagccaacagctctcacccggtcactagcagaccatcatcccctctcataacagtccgggggcccactgaaaacagcagccacaacaccaccggtcagcttgagtccatgacacaatcaacaaccctagtcccaatggcctctccaacacagacagtcctttcacaaagcgtcacctccatagccgttcaagacgcacaccccagctcaacaaacaggtctaaaagaaaccttgaaatggagataatcttaactttacctcagggtttaaaaaagtactatggtaaggtgctcaggcttttgcaactcaccttagaggaggacactgagggcttgctagaatggtgtaagagaaatcttggtcttgattgtgatgatactttctttcaaaagagaattgaagaattcttcataactggtgagggtcatttcaatgaagttctacaatttagaacaccaggcacattgagcaccacagagtctacacatgctgggtcaccaacagctgaaccctttaaatcttatttcgctaaaggcttcctttcaatagattcaggttacttctcagccaaatgttattcaagaacatctaattcagggcttcggctgatcaatgtcactcgacattcaactagaatagctgacacacctgggcccaagatcaccaacctaaaaaccatcagctgcataaatttaagggcatcaatcttcaaagaacatagagaggttgaaatcaatgtgcttctccctcaagttgcagtcaacctctcaaactgtcacgttgctatcaagtcacatgtctgtgactattctttagacgttgatgggacagtgaggcttcctcatatccatcatgggggaaccttcattccaggaacttacaagatagtgatagacaaaaaaaataagctgaatgacagatgtaccctatttaccaactgtgtaataaaagggagagaagttcgtaaaggccaatcaattttgaggcagtataagacagagattaggattggcaaggcatcaactggttctagaagactgctttctgaagaatctggtgacgactgcatatcaagaactcagctactgaggacagagactgcagagatccatggtgatgattatggtggtccgggtgacaagattaccatttgcaatggttcgactattgtagatcaaagactgggtagtgaactggggtgttacactatcaatagagtgaagtcattcaagctgtgcgaaaacagtgcaacagggaagaactgcgaaatagacagcgtcccagttaaatgcaggcagggttattgcctaaaaattactcaggaaggaaggggccatgtgaaattatccaggggctcagaggttgttttggatgcatgcgattcaagctgtgaagtaatgatacctaagggcacaggtgacatctcagtagactgttcaggagggcagcaacattttttgaaagacaacttaattgatctgggatgtcccaagattccattattgggtaaaatggccatttatatttgcagaatgtcgaatcaccctaaaacaaccatggctttcctcttttggttcagttttggctatgtgataacccgtatactctgcaaggccattttctacttattaataattgttggaacactagggaagaggtttaagcaatatagagagttaaaaccccagacctgtaccatatgtgagacaactcctgcaaatgcaatagatgctgaaatgcatgaccttaactgcagttacaacatatgtccctattgtgcatctagactgacctcagatggactcgctaggcatgtgacacaatgccctaagcggaaggagagagtagaagaaactgaattgtacttgaacttagaaagaattccctggattgtaagaaagctgttgcaggtatcggagtccactggtgttgcattaaaaagaagcagctggctgattgtgctacttgtgctgttcacagtttcattatcaccagttcaatcagcacccattggttatgggaatacaattgaaacataccaggccagggaagaatacacaagcatttgcctctttgtactgggaagtatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgctctgctgatagagaaattcatcagctgcacttgagcatctgcaaaaaaagaaaaacaggaagtaatgtcatgcttgcagtctgcaagcgcatgtgcttcagagcaactatggaagtgagcaataaggccctacttatccgtagcatcatcaataccacttttgttgtgtgcatattaatattagcagtctgtattgttagcacctcagcagtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagtcaaaggcatgaaaaatccgctaaactccacaagtttagaaacaagcttgtcgattgaggcaccatggggggcaataaatgttcagtcaacttacaagccaactgtttcaactgcaaacatagcacttagttggagttcaattgaacacagaggtaataatattttggtttcaggcagatcagaatcaattatgaagctggaagaaagaacaggaattagtggggatcttggcgttgaagatgcctctgaatccaagctacttacagtctctgttatggacttgtctcagatgtactcccctgtcttcgagtacttatcaggtgacagacaagtagaagagtggcccaaggcaacctgtacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttatagattatatgttcgtcaagtggaaagttgattacattaaaacagaagccatagtgtgtgtagaactcaccagtcaggaaaggcagtgtagcttggttgaggcgggcacaaggttcaatttaggtcctgtgaccatcacattgtcagaaccgaggaacatacaacaaaagctccctcctgaaataatcacattgcatcctaggattgaagaaggtttttttgatctaatgcatgtgcaaaaagtgctgtcagcaagcacagtgtgtaaattgcagagttgcacacatggtgtgccaggagatctacaggtctaccacatcggaaacttattaaaaggagataaagagaacggacacctaattcataaaattgagccgcacttcaatacttcctggatgtcctgggatggctgtgacctagactactactgcaacatgggagactggccttcttgcacatataccggagttacccagcacaatcatgcttcatttgtaaacctgctcaacattgaaactgactatacaaaaagcttccactttcactctaaaagggttactgcacacggagacacaccacaattggatctgaaggcaagaccaacttacggcgcaggagaaatcactgtactggtagaagttgctgatatggagttacacacgaagaagattgaaataacaggcctcaaatttgcaagcctgacttgcacaggttgttatgcttgtagttcaggcatttcctgcaaagttaggattcatgtggacgagccagatgaacttacagtacatgttaaaagtgatgatccagatgtagttgcagctagctcaagtctcatggcaaggaagcttgagttcgggacagacagtacattcaaagctttctcagccatgcctaaaacttccttatgcttctacattgtcgaaagggagtaccgtaagagctgtagtaaagaggacacacagaaatgtgttaacacaaaacttgagcaaccacagagcattttgatcgaacacaagggaactataatcggaaagcaaaataatacttgcacagccaaagcaagttgctggttagagtcagtcaaaagtttcttttatggtctaaagaacatgcttagtggcatttttggcaatgtttttgtgggcattttcttgtttcttgccccttttatcttgttaatacttttctttatgtttggatggaggatcctgtcttgctttaagtgttgcagaagaaccaggggcctgcttaagcatagacatctcaaagacgatgaagaaactggttacagaaggatcattgaaagactgaacaacaagaaggggaaaaacaagctgcttgatggtgaaagacttgccgatagacggattgccgaactattctccacaaaaacacacattggctag

SEQ ID NO: 3533 - RNA, 5070 nt, synthetic construct
  misc_feature 1..5070: note = derived and/or modified CDS sequence (wt) from CCHFV(88166)__AB069675.1__GP
  source 1..5070: mol_type = other RNA
atgtctttcagcgtcatgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaccctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaacacaagcaaatccaggaaaaataagcatggagaccaatagcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagctctctctcagagtgacacgtccacggccatccaagatatacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagtttttttcctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagacttggagtaatgtcatgctggccgtctgtaagcgcatgtgctttagggcaactgtggaagtaagcaacaaggctctacttatccgaaacatcatcaacaccacttttgttctgtgcatactgatattagcagtttgtgttgtcagcacctccgcagtggagatggaaagcctgccagctggcacttgggagagagaagaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacttagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3534 - RNA, 5070 nt, synthetic construct
  misc_feature 1..5070: note = derived and/or modified CDS sequence (wt) from CCHFV(8402)__AB069674.1__GP
  source 1..5070: mol_type = other RNA
atgtctttcagcgttatgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaccctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaacacaagcaaatccaggaaaaataagcatggagaccaatggcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagccctctctcagagtgacacgtccacggccatccaagatgtacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggtcttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagttttttccctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagactgggagtaatgtcatgctggccgtctgtaagcgcatgtgctttagggcaactgtggaagtaagcaacaaggctctactcatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagagtcaatcatgaagctagaggaaaggacaggaatcagctgggatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3535 - RNA, 5070 nt, synthetic construct
  misc_feature 1..5070: note = derived and/or modified CDS sequence (wt) from CCHFV(7803)__AB069672.1__GP
  source 1..5070: mol_type = other RNA
atgcctgttagcattatgcatatatcattgatgtgtgcagttctttgcttgcagctatatggtctgggggaaactcatggatcaagcaatgaaactgaacacaacaaaacaaacgttgtgacaacgcccggtgacagccagagccctgaaccgctagtgagcacgaccctgcctgtcacgctggactcctccactgtcacacccacaacaccggccagtgaaccagaaggctcgggggaagtttacacatcccccccaatcaccactgagggcctgtctccgtcagaagccacgtcagagctccccgtgacaactggcataggcatctcaagtgcaagtgatgtcgattccagcacacaggcagccggagacacctccacaccaacagtacgcacaagtccacctaacagccctagcacaccacccacatcacaagatacacaccatcctatgagaaatttactttcagtcacgagccttaagtcagaagaaacatcagcaccgtcaaaatcaggcaaagagagtccagcagccagcagccctcacccagtcgccagcagaccaccaacccatcccataacagctcagggacccactgaaaacaacagccataacaccactggacagcttgagtctgtgacacaatcggcaaccctaggcccaatggcctctccaacacagacagtcctctcacaaaatgtcacctccatagccattcaagacacacaccccagcccaacaaataggtctaaaagaaaccttgaaatggagataatcttaactttacctcaaggtttaaagaaatactatggcaaggtgctcaggcttttgcaactcaccttagaggaggacactgaaggcctactagaatggtgtaagagaaatcttggtcttgactgtgatgataccttctttcaaaagagaattgaagagttcttcataactggtgagggtcatttcaatgaagttttacaatttagaacgccaggcacattgagcaccacagagtcaacacatgctgagtcaccaacagctgaaccctttaagtcctatttcgctaaaggcttcctttcaatagattcaggttacttctcagccaaatgttactcaagaacatctgattcagggcttcagttgatcaatgtcactcgacattcaactagaatagctgatacacctgggcccaagattaccaacctaaagaccataagctgcataaacttaaaggcatcagtcttcaaagaacatagagaggttgaaatcaatgtgcttctccctcaagttgcagttaacctctcaaactgtcacgttacaatcaaatcacatgtctgtgactattctttagacattgacgggacagtgaggctacctcacattcatcatgaaggaacctttattccaggaacttacaagatagtgatagacaaaaaaaataagctgaatgacagatgcaccctattcactaactgtgtaataaaagggagggaagttcgtaaaggccaatctgttttgaggcaatataagacagagattaggattggcaaggcatcaactggttctagaagattgctttctgaagaatctggtgatgactgcatatcaagaactcagctattgaggacagagactgcagagatccatggtgataactatggtggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttatcttggatgcatgcgactcaagctgtgaagtaatgatacctaagggcacaggtgacatcctggtagactgttcaggtgggcagcaacattttttgaaggacaacttaattgatctaggatgtcccagtattccattattgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcagtcatgggaagacaattgaaacataccaggccagggaggaatacacaagcatctgcctctttgtactaggaagtatcctgtttatagtctcttgtctaatgaaagggctggttgacagtattggcaacatcttcttccctgggctgtccatttgcaaaacgtgctctataggtagtatcaatggctttgaaattgagtctcataagtgctattgtagcttgctttgttgcccctattgtaggcattgttctgctgatagagaaattcatcagctgcacttgagcatctgcaaaaaaagaaaaacaggaagtaatgttatgcttgcagcctgcaagcgcatgtgcttcagagcaactatggaggtgagcaataaggccctacttatccgtagtatcatcaacaccacttttgttgtgtacatattgatactagcagtctgtgttgttagcacctcagcagttgagatggaaagcctaccagctgggacctgggaaagagaagaagacctaacaaatttctgtcatcaggaatgccaggttacggagactgagtgcctctgcccttatgaagccctagtactcagaaggcccttgttcctggacagtatagttagaggcatgaaaaatccgctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaaccagaggcatagtgtgtgtggaactcaccagtcaggaaaggcagtgtagcttgattgaggcgggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgacctagactactactgcaacatgggagactggccttcttgtacatataccggagttacccaacacaatcatgcttcgtttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcgggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatttttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaataagaaggggaagaacaagctgcttgatggtgaaagacttgccgatagaagaattgccgaactattctccacaaaaacacacattggctag

SEQ ID NO: 3536 - RNA, 5070 nt, synthetic construct
  misc_feature 1..5070: note = derived and/or modified CDS sequence (wt) from CCHFV(75024)__AB069671.1__GP
  source 1..5070: mol_type = other RNA
atgcctgttagcattatgcatatatcattgatgtgtgcagttctttgcttgcagctgtatggtctgggggaaactcatggatcaagcaatgaaactgaacacaacaaaacaaacgttgtgacaacgcccggtgacagccagagccctgaaccgctagtgagcacgaccctgcctgtcacgctggactcctccactgtcacacccacaacaccggctagtggaccagaaggctcgggggaagtttacacatcccccccaatcaccactgagggcctgtctccgtcagaagccacgtcagagctccccgcgacaactggcataggcatctcaagtgcaagtgatgtcgattccagcacacaggcagccggagacacctccacaccaacagtacgcacaagtccacctaacagctctagcacaccacccacatcacaagatacacaccatcctatgaggaatttactttcagtcacgagccttaagccagaagaaacatcagcaccgtcaaaatcaggcaaagagagtccagcagccagcagccctcacccagtcgccagcagaccaccaacccctcccacaacagctcagggacccattgaaaacaacagccataacaccactggacagcttgagtctgtgacacaatcggcaaccctaggcccaatggcctctccaacacagacagtcctctcacaaaatgtcacctccatagccattcaagacacacaccccagcccaacaaataggtctaaaagaaaccttgaaatggagataatcttaactttacctcaaggtttaaagaaatactatggcaaggtgctcaggcttttgcaactcaccttagaggaggacactgaaggcctactagaatggtgtaagagaaatcttggtcttgactgtgatgataccttctttcaaaagagaattgaagagttcttcataactggtgagggtcatttcaatgaagttttacaatttagaacaccaggcacattgagcaccacagagtcaacacatgctgagtcaccaacagctgaaccctttaagtcctatttcgctaaaggcttcctttcaatagattcaggttacttctcagccaaatgttactcaagaacatctaattcagggcttcagttgatcaatgtcactcgacattcaactagaatagctgatacacctgggcccaagattaccaacctaaagaccatcagctgcataaacttaaaggcatcagtcttcaaagaacatagagaggttgaaatcaatgtgcttctccctcaagttgcagttaacctctcaaactgtcacgttacaatcaaatcacatgtctgtgactattctttagacattgacgggacagtgaggcttcctcacattcatcatgaaggaacctttattccaggaacttacaagatagtgatagacaaaaaaaataagctgaatgacagatgcaccctattcactaactgtgtaataaaagggagggaagttcgtaaaggccaatctgttttgaggcaatataagacagagattaggattggcaaggcatcaactggttctagaagattgctttctgaagaatctggtgatgactgcatatcaagaactcagctattgaggacagagactgcagagatccatggtgataactatggcggtccgggtgacaagattactatttgcaatggttcgacaattgtagatcaaagactgggtagtgagatggggtgttacactatcaatagggtgaagtcattcaagctgtgcgaaaacagtgcaacagggaagagctgtgaaatagacagtatcccagttaagtgcaggcagggttattgcctaaaaatcactcaggaaggaaggggccatgtgaaattatccaggggctcagaggttgtcttggatgcatgcgactcaagctgtgaagtaatgatacctaagggcacaggtgacatcctggtagactgttcaggtgggcagcaacattttttgaaggacaacttaattgatctaggatgtcccagtattccattactgggtaaaatggctatttatatttgcagaatgtcgaatcaccctaagacaaccatggctttcctcttttggttcagttttggctatgtgataacttgtatactctgcaaggctattttctacttattaataattgttggaacgctagggaagaggtttaagcagtacagagagttaaaaccccagacctgtaccatatgtgagacaactcctgcaaatgcaatagatgctgaaatgcatgaccttaactgcagttacaacatatgtccctattgtgcatctagactaacctcagacgggcttgctaggcatgtgacacaatgccctaagcggaaggagaaagtagaagaaactgaattgtacttgaacttagagagaattccctgggttgtaagaaagctgttgcaggtatcggagtccaccggtgttgcattaaaaagaagcagctggctgattgtgctgcttgtgctgttcgcaatttcattatcaccagttcaatcagcacccatcggtcatgggaagacaattgaaacataccaggccagggaggaatacacaagcatctgcctctttgtactaggaagtatcctgtttatagtctcttgtctaatgaaagggctggttgacagtattggcaacatcttcttccctgggctgtccatttgcaaaacgtgctctataggtagtatcaatggctttgaaattgagtctcataagtgctattgtagcttgctttgttgcccctattgtaggcattgttctgctgatagagaaattcatcagctgcacttgagcatctgcaaaaaaagaaaaacaggaagtaatgttatgcttgcagtctgcaagcgcatgtgcttcagagcaactatggaagtgagcaataaggccctacttatccgtagtatcatcaacaccacttttgttgtgtgcatattaatactagcagtctgtgttgttagcacctcagcagttgagatggaaagcctaccagctgggacctgggaaagagaagaagacctaacaaatttctgtcatcaggaatgccaggttacggagactgagtgcctctgcccttatgaagccctagtactcagaaggcccttgttcctggacagtatagttagaggcatgaaaaatcagctaaactcaacaagtttagaaacaagcttatcgattgaggcaccatggggagcaataaatgttcagtcaacctacaaaccaactgtgtcaactgcaaacatagcacttagttggagctcagttgaacacagaggtaataagattttggtttcaggcagatcagaatcaattatgaagctggaagaaaggacaggaatcagctgggaccttggcgtagaagatgcctctgaatctaagctacttacagtctctgtcatggacttgtctcagatgtactctcctgtcttcgagtacttatcaggtgacagacaagtagaagagtggcccaaggcaacctgtacaggagactgcccagaaagatgtggctgcacaacatcaacctgcttgcataaagaatggccccattcaagaaactggagatgtaatcccacttggtgctggggggtggggactggctgcacttgttgtggattagatgtgaaagacctttttacagattatatgattgtcaagtggaaagttgaatacattaaaacagaggccatagtgtgtgtggaactcaccagtcaggaaaggcagtgtagcttgattgaggcaggcacaaggttcaatttaggttctgtgaccatcacattgtcagaaccgaggaacattcaacaaaagctccctcctgaaataatcacattgcatcctaggattgaagaaggtttttttgacctgatgcatgtacaaaaagtgttgtcagctagcacagtgtgtaagttgcagagttgcacacacggtgtgccaggtgatctacaggtctaccatgtcggaaatttattaaaaggagataaggtgaatggacacctaattcataaaattgagccacacttaaacacttcctggatgtcctgggatggctgtgatctagactactattgcaacatgggagactggccttcttgtacatataccggagttacccaacacaatcatgcttcatttgtaaacctgctcaacattgaaactgactatacaaaaagcttccactttcactctaaaagggttactgcacacggagacacaccacaattagatctgaaggcaagaccaacctacggcgcaggagaaatcactgtactggtagaagttgctgacatggagttcacaccgaagaagattgaaatatcaggcctaaaatttgcaagcctgacttgcacaggctgttatgcttgtagttctggcatttcctgcaaagttaggattcatgtggatgaaccagatgaacttacagtacatgttaagagtgatgatccagatgtagtagcagctagctcaagtctcatggcaaggaagcttgagtttggaacagacagtacatttaaagctttctcagctatgcccaaaacttccttatgtttctacattgtcgaaagggagtactgtaagagctgcagtaaagaagacacacaaaaatgtgttaacacaaaacttgagcaaccacagagcattttgatcgaacataagggaactataattggaaagcaaaacaatacctgcacagccaaagcaagttgctggttagagtcggttaaaagtttcttttatggtctaaagaacatgcttagtggcatttttggcaatctttttatgggcatcttcttatttcttgcccccttcatcttgttaatacttttctttatgtttggatggaggatcctgttttgctttaagtgttgcagaagaaccaggggcctgttcaagtatagacatctcaaagacgatgaagaaactggttacaggaggatcattgaaagactgaacaacaagaaggggaagaacaagctgcttgatggtgaaagacttgccgatagaagaattgccgaactattctccacaaaaacacacattggctag

SEQ ID NO: 3537 - RNA, 5070 nt, synthetic construct
  misc_feature 1..5070: note = derived and/or modified CDS sequence (wt) from CCHFV(66019)__AB069669.1__GP
  source 1..5070: mol_type = other RNA
atgcctgccaacattatgtatacactgttagtgtgtgctgttctctgtccacagctgtggagtctggaagggacccatgttccacacaacgagactaaacacaatggaactggcatcacagcagcacctggagagagtcaaggccccatgtcgcctgcgagcacagcagtgcccctcacaccggaacccccaaacaccaaacctgcagcatcagccagcgaactggaaagctcgggggaagggcacacctcccttttagccaccacacaaggtctgacttcgccggaggccacgccggagctcccaacaacaaccgacacaggcgtatcaagcacaagcgtcgtcgacattggcacacagatggccaaagacactcccacatcgacagcccacacaagcctgcccagcaatcccagtgcaccatccacagcacaaggcacacatcacactataagaggtctgctgtcagttaccagcaccaagccagaagaagcatcaacaccaacagacccaggaaaggcgggtgcagagaccggcagcccaagaccagccatcagcagaaaaccaaccctctcaccaacagctgaagctcccactgaaatcaacaactctagcacccccaaacaacccgagccctcaatacaaccagcaaccccaagcctagtgatctctccagcacagccagccttcccacagagtgctacttccacagctgctcaagatatatactctagcccaacaaacagatctaaaagaaaccttaagatggaaataattttgactttgtctcaaggtctaaagaagtactacggtaagatacaaaaaactctgggtctcaccttagaagaagacactgaaggtctgctggagtggtgtaagagaaatcttggtctgacctgtgatgataatttcttccaaaagagaatagaagagttttttttgaccggtgaaggctacttcaatgaagttttacagtttaaaacaccaagcacaccaggctccacagaaccgactcataccgaggcaccaacagttaaaccctttaaatcttactttgctagaggcttccttacaatagactcaggttacttctctgccaagtgctattcaaggacttctaactcaggacttcagttgatcaacgtcacccagcatccagccagaatagcagacacacctggacccaagatcactaatctgaagaccatcaattgtataaacttaaaagcatcagtctttaaagagcatagagagatcgaaatcaatgtgcttctcccacaagtcgcggtcaacctctcaaactgccacgttctgatcaaatcacatgtctgtgactactctttagacatcgatgggacaataagactacctcgtatctaccatgaaggaacatttataccaggaacctataaaatagtaatagacaaaagagataagcaaaacgacagatgcaccttggtcaccaattgtgtaataaaaggaagggaggttcgtagaggccagtcagcattaaggcaatacaggacagaaatcagaataggcaaggcatctgctggctctagaagattgctgtccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataacaccccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctaattgtgttacttgtgctacttacagtttcattgtcaccggttcaatcagcacccattggacatggaaagacaattgaggcatatcagaccagagaggggtacacaagtgtttgcctgtttatgctgggaggcatcttgtttgtggtctcctgcctgatgaaagggctagttgacagtgtcagcaacagctttttccctgggttatctatttgcaaaacctgttctatcggcagtgtaaatggctttgaaattgaatcccataaatgttactgtagcttactttgttgcctttattgtagacattgctctgctgatagggaaatccaccaattgcacttgagcatctgcaaaaaaagaagggcaggaggcaatgtcatgctggctgtctgcaagcgcatgtgcctcagagcaactatggaggtaagcaataaggtcctattcatccgaagtattatcaacaccacttttgttatatgcatactggtattggcagtctgtatcgttagcacctccgcagtagagatggaaagcctaccagccggcacttgggaaagggaggaagacctgacaaacttctgccaccaggaatgccaagtcacagagactgaatgtctctgtccttacgaggctcttgtactcaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgagtctaagttgcttactgtttctgtcatggatttgtcacagatgtattctcctgtctttgagtacttatcaggtgacagacaggtagaggagtggcccaaagcaacctgcacaggtaattgcccagataggtgtggctgcacatcatcaacctgcttacacaaggaatggccccattcaaggaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttccttctgaaataatcacattgcatcctagaattgaggaaggcttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaagagagttactgcacatggagacacaccacagctggatttgaaagctagaccaacttacggtgcgggtgaaatcactgtactagtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacaataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggttaa

SEQ ID NO: 3538 - RNA, 5070 nt, synthetic construct
  misc_feature 1..5070: note = derived and/or modified CDS sequence (wt) from CCHFV(BA8402)__AF350449.1__GP
  source 1..5070: mol_type = other RNA
atgtctttcagcgttatgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaacctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaccacaagcaaatccaggaaaaataagcatggagaccaatggcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagccctctctcagagtgacacgtccacggccatccaagatgtacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacaatgataactatggtggtccaggtgacaagataaccatctgcaatggttcaactgttgtggatcagagattgggcagtgaactggggtgttacactatcaatagagtaaactcttttaacctttgcgaaaacactgccacgggcaaatcctgtgaaatagatagcaccccagtcaaatgcaggcagggtttctgtttgaaaattactcaggagggaaggggccacgtgaagctatcgagaggttcagaagttgtcctggacgcctgcgaatcaagctgtgaaataatgataccaaagggcaccggagacatcctagttgactgttcaggtggacagcaacatttcttaaaagataacttgattgatctaggatgcccaaacatcccactattaggcaagatggctatctacatttgtagaatgtcaaatcatcctaaaacgactatggcttttcttttttggtttagctttggttatgtggtgacctgtatactctgtaaggtcatcttctatctattaatagttgtggggacgttggggaaaaagttcaaacagtatagagagttgaaacctcagacctgtaccatatgcgaaacaactcctgttaatgcaatagatgctgaaatgcacgacctcaattgcagttacaatatatgtccatactgtgcatctaggccaacctcagatggtcttgccagacatgttatgcagtgccctaagcggaaggaaaaaattgaagaaaccgcattatacttaaacttggaaagaatcccctgggttgttaggaaattactgcaggtgtcagaatccaccggtgtggcactaaagaggagtagttggctggttgtgctacttgtgctacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagttttttccctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagactgggagtaatgtcatgctggccgtctgtaagcgcatgtgctttagggcaactgtggaagtaagcaacaaggctctactcatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgttttcagacagcattgtcaaaggcatgaagaacttgctaaattcaacaagcttagaaacaagcttatcaattgaggcaccatggggagcaataaatgtccaatcaaccttcaaacctactgtgtcagctgcgaatatagctcttagttggagctcagtggaacacaggggtaataagattttggtttcaggtagatcagaatcaatcatgaagctagaagaaaggacaggaatcagctgggatctaggggtagaagatgcttctgaatctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgaccatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctacactactactgtaatatgggggattggccatcttgcacatatactggagtcacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagaccccgacatagttgctgctagctcaagtctcatggctaggaagcttgaatttgggacagatagtacattcaaagccttttcagccatgcccaaaacctccttatgcttctacattgtggagagagaatattgtgaaagctgcagcaaagaagatacacaaaaatgtgttaacacaaagcttgagcaaccacagagcattttaatcgagcacaaaggcacgataattggtaagcagagcaacacctgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3539 - RNA, 5070 nt, synthetic construct
  misc_feature 1..5070: note = derived and/or modified CDS sequence (wt) from CCHFV(BA66019)__AF350448.1__GP
  source 1..5070: mol_type = other RNA
atgcctgccaacattatgtatacactgttagtgtgtgctgttctctgtccacagctgtggagtctggaagggacccatgttccacacaacgagactaaacacaatggaaccggcatcacagcagcacctggagagagtcaaggccccatgtcgcctgcgagcacagcagtgcccctcacaccggaacccccaaacaccaaacctgcagcatcagccagcgaactggaaagctcgggggaagggcacacctcccttttagccaccacacaaggtctgacttcgccggaggccacgccggagctcccaacaacaaccgacacaggcgtatcaagcacaagcgtcgtcgacattggcacacagatggccaaagacactcccacatcgacagcccacacaagcctgcccagcaatcccagtgcaccatccacagcacaaggcacacatcacactataagaggtctgctgtcagttaccagcaccaagccagaagaagcatcaacaccaacagacccaggaaaggcgggtgcagagaccggcagcccaagaccagccatcagcagaaaaccaaccctctcaccaacagctgaagctcccactgaaatcaacaactctagcacccccaaacaacccgagccctcaatacaaccagcaaccccaagcctagtgatctctccagcacagccagccttcccacagagtgctacttccacagctgctcaagatatatactctagcccaacaaacagatctaaaagaaaccttaagatggaaataattttgactttgtctcaaggtctaaagaagtactacggtaagatacaaaaaactctgggtctcaccttagaagaagacactgaaggtctgctggagtggtgtaagagaaatcttggtctgacctgtgatgataatttcttccaaaagagaatagaagagttttttttgaccggtgaaggctacttcaatgaagttttacagtttaaaacaccaagcacaccaggctccacagaaccgactcatgccgaggcaccaacagttaaaccctttaaatcttactttgctagaggcttccttacaataaactcaggttacttctctgccaagtgctattcatggacttctaactcaggacttcagttgatcaacgtcacccagcatccagccagaatagcagacacacctggacccaagatcactaatctgaagaccatcaattgtataaacttaaaagcatcagtctttaaagagcatagagagatcgaaatcaatgtgcttctcccacaagtcgcggtcaacctctcaaactgccacgttctgatcaaatcacatgtctgtgactactctttagacatcgatgggacaataagactacctcgtatctaccatgaaggaacatttataccaggaacctataaaatagtaatagacaaaagagataagcaaaacgacagatgcaccttggtcaccaattgtgtaataaaaggaagggaggttcgtaaaggccagtcagcattaaggcaatacaggacagaaatcagaataggcaaggcatctgctggctctagaagattgctgtccgaagagtctggtgacgactgcatatctagaactcagctattgaggacagagactgcagaggtccatggtgacaactatggtggtccaggtgacaaaataactatctgtaatggttcaaccattgtggatcaaagacttggcagtgaactggggtgttatactatcaatagagtgaagtcattcaagctatgcgaaaatagtggcacgggaaaatcctgtaagatagataaacacccagttaagtgcaggcagggtttttgcttaaaaattactcaggaaggaaggggccatgtgaagctatcgagaggctcagaagttgtcttagatgcctgcgactcaagctgtgaaataatgataccgaagggcacaggagacatcctagtagactgttcaggtgggcaacaacatttcttaaaagataacttggttgatctaggatgccctaacattccactattaggtaaaatggctatctacatttgcaggatgtcaaatcaccctaaaacaactatggcttttctcttttggtttagtttcggctatgtaataacatgtatattttgtaaaatcattttttacttgttgatagtcgtggggacattggggaaaaagttcaaacagtaccgggagctgaaacctcagacttgtactatatgtgaaacaactcctaccaatgcaatagatgctgaaatgcacgatcttaaatgcagttacaatatatgcccttattgtgcatctagattaacctcggacgggcttgccaggcatgtgacacaatgccctaagcgaaaagagaaagtagaagagactgaactgtacttgaacttggaaagaattccttggattgtcagaaaactactgcaagtgtcagagtctaccggtgtggcactgaaaaggagcagttggctgattgtgttacttgtgctacttacagtttcattgtcaccggttcaatcagcacccattggacatggaaagacaattgaggcatatcagaccagagaggggtacacaagtgtttgcctgtttatgctgggaggcatcttgtttgtggtctcctgcctgatgaaagggctagttgacagtgtcagcaacagctttttccctgggttatctatttgcaaaacctgttctatcggcagtgtaaatggctttgaaattgaatcccataaatgttactgtagcttactttgttgcctttattgtagacattgctctgctgatagggaaatccaccaattgcacttgagcatctgcaaaaaaagaagggcaggaggcaatgtcatgctggctgtctgcaagcgcatgtgcctcagagccactatggaggtaagcaataaggtcctattcatccgaagtattatcaacaccacttttgttatatgcatactggtattggcagtctgtatcgttagcacctccgcagtagagatggaaagcctaccagccggcacttgggaaagggaggaagacctgactaacttctgccaccaggaatgccaagtcacagagactgaatgtctctgtccttacgaggctcttgtactcaggaaacccctattctcagacagtatagtcaagggcatgaaaaacctgctaaattcaactagcttggaaacaagcttatcaattgaagcaccatggggagcaataaacgtccagtcaacctttaaacccaccgtttcaactgcaaacatagcacttagctggagttcagtagaacacagaggtaacaaaattttggtctcaggcagatcagaatcaattatgaagctagaagaaaggacaggaatcagctgggatctgggcgtagaagatgcctctgaatctaagttgcttactgtttctgtcatggatttgtcacagatgtattctcctgtctttgagtacttatcaggtgacagacaggtagaggagtggcccaaagcaacctgcacaggtgattgcccagataggtgtggctgcacatcatcaacctgtttacacaaagaatggccccattcaagaaattggagatgcaaccccacttggtgttggggagtcggcactggatgcacctgctgtggactagatgtgaaagatctttttacagattatatgtttgtcaagtggaaagttgaatacataaagaccgaggccatagtgtgcgttgagctcaatagccaagaaaggcagtgcagcttgattgaggcaggcacaagattcaacttgggtcctgtgaccatcacgttgtcagaaccaagaaacattcagcagaagcttcctcctgaaataatcacattgcatcctagaattgaggaaggtttcttcgatctgatgcatgttcaaaaggtgctgtctgcaagtacagtatgcaagctacaaagctgcacacatggtgtgccaggagacttacagatctaccacattggcaacttgttaaaaggggatagggtaaatgggcatctgattcacaaaattgagccacacttcaacacttcttggatgtcctgggatggctgtgacctagattactactgtaacatgggggattggccctcttgcacatatactggagtgacccaacataaccatgctgcttttgtaaacttacttaacatcgaaactgattacacaaagaacttccattttcattctaaaagggttactgcccatggagacaccccacaactggatcttaaagctagaccaacttacggtgcgggtgaaatcactgttctggtggaggttgctgacatggagttacacacaaaaaagattgcgatatcaggtctgaaatttgcaagtttgacttgcacaggttgctatgcttgtagctctggcatctcctgtaaagtcaggattcatgtggatgaaccagatgagcttacagtacatgtgaaaagtgaagatccggacattgttgcagccagctcaagcctcatggcaaggaagcttgaatttgggacagacagcacattcaaggccttctcagccatgcccaaaacctccttgtgcttctacattgtagagagagaatactgtgagagctgcagcaaagaagacacacagaaatgtgttaacacaaagcttgagcaaccacaaagcattttaattgagcacaaaggaacgataatcggaaagcaaaatgacacttgcacagccaaagcaagctgctggttagagtcagtaaagagttttttttatggattgaagaacatgcttagcggcatcttcggcaacgtttttataggcattttcttattccttgctccttttattctgttaatactcttctttatgtttgggtggagaatcctgttttgctttaagtgttgcagaaggaccagaggcttattcaagtacagatatctcaaggacgacgaagagtctggttacagaagaatcattgaaagattaaacaacaaaaaaggaaaaaacaagttacttgacggtgaaagactagctgacaggaggatcgctgagttgttctctaccaaaacacacattggttaa

SEQ ID NO: 3540 - RNA, 5070 nt, synthetic construct
  misc_feature 1..5070: note = derived and/or modified CDS sequence (wt) from CCHFV(BA88166)__AF338470.1__GP
  source 1..5070: mol_type = other RNA
atgtctttcagcgtcatgtacacaccacttttgtgtgctgttctttgcttacagctgtggagtttagaagggtctcatggactgtccaacaaaacccaacacagtaatacaagcaccacaaaggcgcctgaagtaagccaggaacttggattgcctgtgagcacagtatcgactatcacgtcagaccctccttccatcacatccgcagtatcagtcagtggatcagaaggctcaggagacacgaacacctctccctcggtcaccacacaaggcccgactttgccagaaaccacgctggaacccctaacaacaaccgacacagatgcatcaagcactgtcgtcgtcgatgtcagcacacagacggtcaaggacacccctatatcaacaacctacacaagtttgcccagtactcccagcgagccaactacaccacagggtacacatcatactgcaaggggtctactgtcagtcaccagcacaaagccagaagaagcatcaacacaagcaaatccaggaaaaataagcatggagaccaatagcccgcgcctagccatcagcgagacaccatccttctctccaacaactcaggctcctaccgaaaacagcaaccccatcacatccaaacagcttatgctctcagcacaaccagtaaccccaaacccaatgacctctccagtacagccagctctctctcagagtgacacgtccacggccatccaagatatacacccaagcccaacaggcagatctaaaagaaaccttgagatggaaataattttgactttatctcaaggtttgaagaagtactacggcaagatactaaaacttctggaccttactttggaagaagacactgaaggcctgctagagtggtgtaagagaaatcttggtttggtctgtgatgacaacttctttcagaagaggatagaagagttttttttgactgggaagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaatgtcacccaacattcaactagaataacagacacacctggacccaagatcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgacgggccagtaagactaccccgcatccaccatgaaggaactttcataccaggaacttacaaaatagttatagacaaaaaaaacaaacaaaatgatagatgcactttggtcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctattgaggacagagactgcggaaattcacagtgataactatggtggtccaggtgacaagataaccatctgcaatggttcaactgttgtggatcagagattgggcagtgaactagggtgttacactatcaatagagtaaagtcatttaagctttgcgagaacagtgccacaggcaaatcctgtgaaatagatagcaccccagtcaaatgcaggcagggtttctgtttgaaaattactcaggagggaaggggccacgtgaagctatcgagaggttcagaagttgtcctggacgcctgcgattcaagctgtgaaataatgataccaaagggcactggagacatcctagttgactgttcaggtggacagcaacatttcttaaaagataacttgattgatctaggatgcccaaacatcccactattaggcaagatggctatctacatttgtagaatgtcaaatcatcctaaaacgactatgggttttcttttttggtttagctttggttatgtggtgacctgtatactctgtaagggcatcttctatctattaatagttgtggggacgttggggaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagatggccttgccagacatgtaatgcagtgccctaagcggaaggaaaaaatagaagaaaccgaattatacttaaacttggaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaaggatacacaagtatttgcctctttgtactaggaagcatcttatttatagtctcttgcctaatgaaggggttggttgacagtgttggtaacagtttttttcctggtttgtccatttgtaagacatgttctattggcagtgtaaatggctttgagattgaatctcacaaatgttactgtagcctattttgttgtccctactgtagacactgctctgccgatagagaaatacataggttgcacttgagcatctgcaagaaaaggaagacttggagtaatgtcatgctggccgtctgtaagcgcatgtgctttagggcaactgtggaagtaagcaacaaggctctacttatccgaaacatcatcaacaccacttttgttctgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccctacgaagctcttgtgctcaggaaacccttgtatttagacagcattgtcaaaggcatgaagaacttgctaaattcaacaagcttagaaacaagcttatcaattgaggcaccatggggagcaataaatgtccaatcaaccttcaaacctaccatgtcagctgcgaatatagctcttagttggagctcagtggaacacaggggtaataagattttggtttcaggtagatcagagtcaatcatgaagctagaggaaaggacaggaatcagctggaatctaggggtagaagatgcttctgagtctaaattgcttactgtctctgttatggacttgtcacagatgtactctcctgtctttgagtacctatcaggtgacagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttatcaagtggaaagttgagtacattaaaacagaagctatagtgtgtgttgagcttactagccaagagagacaatgtaccttgattgaggcaggcacaagattcaacttaggtcctgtgatcatcacattgtcagagccaagaaacattcagcaaaagctccctccagagatagttacattgcaccccagaattgaagaaggtttctttgatttaatgcatgtacaaaaggtgctatcagcaagtacagtgtgtaagctacagagttgcacacatggtgtgccaggggacctacaggtctatcacataggaaacttgttaaaaggagacaaggtgaatgggcacctgattcacaaaattgaaccacacttcaacacttcctggatgtcttgggacggctgtgacctagactactactgtaatatgggggattggccatcttgcacatatactggagtaacccagcacaatcatgctgcatttgtaaacatgctcaacatcgaaactgattatacaaaaaacttccactttcactctaagagagttactgcacatggagacacaccacaattagatttgaaagctagaccaacttatggtgcaggtgaaatcactgtgctggtggaagttgctgacatggagttacacacaaagaaaattgagatatcaggtttgaagtttgcaagcttaacttgcacaggctgttatgcttgtagctctggtatctcctgtaaggttagaatccatgtagatgagccagatgagcttacagtacatgtgaagagtgaagacccagacatagttgctgctagctcaagtctcatggctagaaaacttgaatttgggacagatagtacattcaaagccttttcagccatgcccaaaacctccttatgcttttacattgtggagagagaatattgtaaaagctgcagcaaagaagatacacaaaaatgtgtcaacacaaagcttgagcaaccacagagcattttaatcgagcacaaaggaacgataattggtaagcagaacaacacatgcacagctaaagcaagctgttggctagagtcagtcaagagcttcttttatgggctaaagaacatgcttagtggcatttttggcaatgttttcataggggttttcttattctttgctccttttatccttttgatacttttctttatgtttggatggagaatcctgttctgctttaaatgttgcagaagaactagaggcctttttaagtacagacacctcaaggacgatgaagaaaccggttacaggaaaatcattgagagactgaacaacaaaaaagggaaaaacaaactgcttgatggtgaaagattagctgataggaagattgctgagctgttctccacaaagacacacattggctaa

SEQ ID NO: 3541 - RNA, 5070 nt, synthetic construct
  misc_feature 1..5070: note = derived and/or modified CDS sequence (wt) from CCHFV(UCCR4459)__KY484032.1__GP
  source 1..5070: mol_type = other RNA
atgtcttttagcattatgtacacaccacttttgtgtgctgttctttgcttacagctgtggagtttagaagggtctcatggactgtccaacaaaacccaacacagtaatacaagcaccacaaaggcgcctgaagtaagccaggaatttggattgcctgtgagcacagtatcgactatcacgtcagaccctccttccatcacatccgcagtatcagtcagtggatcagaaggctcaggagacacgaacacctctccctcggtcaccacacaaggcctgactttgccagaaaccacgctggaactccttacaacaaccgacacagatgcatcaagcactgtcgtcgtcgatgtcagcacacagacggtcaaggacacccccatatcaacaacccacacaagtttgcccagtactcctagcgcgacaactacaccacagggtacacaccatactgcaaggggtctactgtcagtcaccagcacaaagccagaaggagcatcaacacaagcaaatccagaaaaaataagcatggagaccaatagcccgcgcctagccatcagcgagacaccatccttctctccaacaactcaggctcctaccgaaaacagcaaccccatcacatccaaacagctcatattctcagcacaaccagtaaccccaaacccagtgacccctccagtacagccagccctctctcagagtgacacgtccacggccatccaggatatacaccccagcccaacaagcagatctaagagaaaccttgagatggaaataattttgactttatctcagggtttgaagaagtactacggcaagatactaaaacttctggaccttactttggaagaagacactgaaggcctgctagagtggtgcaagagaaatcttggtttggtctgtgatgatgacttctttcagaagagaatagaagagttttttttgactggggagggtcacttcaatgaagtcttacagttcaaaacaccaagcacactaagccccacgggaccagcccgaactgggtcaccaacagtggaaccttttaaatcttacttcgctaaagggtttctttcaatggactcaggctacttctctgccaagtgttatccaagagcatccaattcaggacttcagctgatcaacgtcacccaacattcaactagaataacagacacacctggacccaaggtcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgatgggccagtaaggctaccccgcatccaccatgaaggaactttcataccaggaacttacaaattagttatagacaaaaaaaacaaacaaaatgacagatgcactttgatcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggtttgtccatttgtaagacatgttctattggcagcataaatggctttgagattgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggctaa

SEQ ID NO: 3542 - RNA, 5070 nt, synthetic construct
  misc_feature 1..5070: note = derived and/or modified CDS sequence (wt) from CCHFV(K168_125)__KX013460.1__GP
  source 1..5070: mol_type = other RNA
atgcccatcagcaccatgcacatatcactgatgtgtgcagttctttgcctgcagctgtatggtctggggggaacccatgggttacacaatggaactgaacacaataagacaaacgctgtgacaacgtccagtaacagccagagctcagaatcaccagcaagaacggccccacctgtcacgccggactcccccaccgtcacacccacaactccagccagcgcaccagaaggctcaggggaggcccactcatcccccccaaacaacacagagggcccgtctctgccggagtccacgtcagagccccccgcggcaaccagcacaggcatcccaagtgcaagtgatgtcaactccagcacacaggcagccagagacacctccacaccaacagtccgcaccagtccccccaacagccccagcacaccacccacaccacaagaaacacaccatcctgtgaggaatctactttcagtcacgagccataagcccgaagaaacatcagcaccgtcagaatctggcaaagagagtccagcagccaacagcccccacccagtcgccagcagaccaccaaccccctccacaacagcccaaggacctactgaaaacaacaactacaacaccaccggacagcttgagtccttgacacagtcgacaaccttaggcccaatgacctctctaacacagacagacctcccacagagtgtcacctccatagctgttcaagacacgcaccctagcccaacgaacaggtccaaaagaaaccttgaaatggaaataatcttaactttacctcagggtttaaaaaaatactatggcaaggtgctcaggcttctgcaactcaccttagaggaggacactgaaggcctgctagaatggtgtaagagaaaccttggtctcgattgtgatgacactttctttcaaaagagaattgaagaattcttcataactggtgagggtcatttcaatgaagttttacaatttagaacaccaggcacattgagcaccacagagtcaacacatgctgggttaccaacagctgaaccctttaaatcttatttcgctaaaggcttcctttcaatagactcaggttacttctcagccaaatgttactcaagaacatctaattcagggcttcagctgattaatgtcactcgacattcaactagaatagccgacacacccgggctcaagattaccaacctgaagactatcagctgcataaacttaaaggcatcagtctttaaagaacatagagaggttgaaattaatgtgcttctccctcaagttgcagttaacctctcaaactgtcacgttacaatcaaatcacatgtctgtgactattctttagacattgacggaacagtgaggcttcctcacattcatcatgacggaacctttatcccaggaacttacaagatagtgatagacagaaaaaacaagctgaatgacagatgtaccttattcaccaactgtgtgataaaagggagagaggttcgtaaaggccaatcagttttgaggcagtataagacagagattaggattggcaaggcatcaactggttctagaagattgctttctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaagttccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtcatgggaagacaattgaaacataccaggtcagggaggaatacacaagtatttgcctctttgtactgggaagtatcttgttcatagtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgacagggaaattcatcaattgcacttgagcatctgcaagaaaagaaaaacaggaagtaatgtcatgcttgctgtttgcaagcgcatgtgtttcagagcaactgtggaagtgagcaacaaggccctatctatccgtagcatcatcaacaccacttttgttgtgtgcattttaatactagcagtctgtgttgttagcacttcagcagtagagatggaaagcctaccagctgggacctgggaaagagaagaagatctaacaaatttctgtcatcaggaatgccaggtcacggagactgagtgcctctgcccttatgaggctctagtactcagaaggcccctgtttctggacagtatagtcaaaggcaagaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggctaa

SEQ ID NO: 3543 - RNA, 5070 nt, synthetic construct
  misc_feature 1..5070: note = derived and/or modified CDS sequence (wt) from CCHFV(K168_40)__KX013457.1__GP
  source 1..5070: mol_type = other RNA
atgcccatcagcaccatgcacatatcactgatgtgtgcagttctttgcctgcagctgtatggtctggggggaacccatgggttacacaatggaactgaacacaataagacaaacgctgtgacaacgtccagtaacagccagagctcagaatcaccagcaagaacggccccacctgtcacgccggactcccccaccgtcacacccacaactccagccagcgcaccagaaggctcaggggaggcccactcatcccccccaaacaacacagagggcccgtctctgccggagtccacgtcagagccccccgcggcaaccagcacaggcatcccaagtgcaagtgatgtcaactccagcacacaggcagccagagacacctccacaccaacagtccgcaccagtccccccaacagccccagcacaccacccacaccacaagaaacacaccatcctgtgaggaatctactttcagtcacgagccataagcccgaagaaacatcagcaccgtcagaatctggcaaagagagtccagcagccaacagcccccacccagtcgccagcagaccaccaaccccctccacaacagcccaaggacctactgaaaacaacaactacaacaccaccggacagcttgagtccttgacacagtcgacaaccttaggcccaatgacctctctaacacagacagacctcccacagagtgtcacctccatagctgttcaagacacgcaccctagcccaacgaacaggtccaaaagaaaccttgaaatggaaataatcttaactttacctcagggtttaaaaaaatactatggcaaggtgctcaggcttctgcaactcaccttagaggaggacactgaaggcctgctagaatggtgtaagagaaaccttggtctcgattgtgatgacactttctttcaaaagagaattgaagaattcttcataactggtgagggtcatttcaatgaagttttacaatttagaacaccaggcacattgagcaccacagagtcaacacatgctgggttaccaacagctgaaccctttaaatcttatttcgctaaaggcttcctttcaatagactcaggttacttctcagccaaatgttactcaagaacatctaattcagggcttcagctgattaatgtcactcgacattcaactagaatagccgacacacccgggcccaagattaccaacctgaagactatcagctgcataaacttaaaggcatcagtctttaaagaacatagagaggttgaaattaatgtgcttctccctcaagttgcagttaacctctcaaactgtcacgttacaatcaaatcacatgtctgtgactattctttagacattgacggaacagtgaggcttcctcacattcatcatgacggaacctttatcccaggaacttacaagatagtgatagacagaaaaaacaagctgaatgacagatgtaccttattcaccaactgtgtgataaaaggaagagaggttcgtaaaggccaatcagttttgaggcagtataagacagagattaggattggcaaggcatcaactggttctagaagattgctttctgatgagtctggtgatgactgcatatcaaggactcagctactgagaacagagactgcagagatccatggtgacaattatggtggtccgggtgacaagattaccatttgcaatggttcaactattgtagaccaaagactgggcagtgaactggggtgttacactatcaatagagtgaagtcattcaagctgtgcgaaaacagtgccacagggaagagctgtgaagtagacagtatcccagtaaaatgcaggcagggttattgcctaaaaatcactcaggaaggaaggggccacgtgaaattatccagaggttcagaggttgtcttggatgcatgcgattcaagctgtgaagtaatgatacctaagggcacaggtgacatcctagtggactgttcaggtgggcagcaacatttcttgaaggacaacttaattgacctaggatgtcccaaaattccattgttgggcaaaatggctatttatatttgcagaatgtcgaatcaccccaagacaaccatggctttcctcttttggttcagttttggctatgtgataacttgtatagtctgcaaggccattttttacttattaataattgttggaacactagggaagaggtttaagcagtatagagagttaaaaccccagacctgcaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaagagaaagtagaagaaactgaattgtacttgaacttagagagaattccctgggttgtaagaaagctgttgcaggtatcagagtccaccggtgtagcattaaaaagaagcagctggctgattgtgctgcttgtgctgtttgcagtttcattatcaccagttcaatcagcacctattggtcatgggaagacaattgaaacataccaggtcagggaggaatacacaagtatttgcctctttgtactgggaagtatcttgttcatagtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgacagggaaattcatcaattgcacttgagcatctgcaagaaaagaaaaacaggaagtaatgtcatgcttgctgtttgcaagcgcatgtgtttcagagcaactgtggaagtgagcaacaaggccctatctatccgtagcatcatcaacaccacttttgttgtgtgcattttaatactagcagtctgtgttgttagcacttcagcagtagagatggaaagcctaccagctgggacctgggaaagagaagaagatctaacaaatttctgtcatcaggaatgccaggtcacggagactgagtgcctctgcccttatgaggctctagtactcagaaggcccctgtttctggacggtatagtcaaaggcatgaaaaacctgctaaactcaacaagtttggaaacaagcttgtcgattgaggcaccatggggggcaataaatgttcagtcaacctacaaaccaactgtatcagctgcaaacatagcacttagttggagttcagttgaacacagaggtaataagattttggtttcaggcagatcagaatcaattatgaagctggaagaaaggacaggaatcagctgggatcttggcgtagaagatgcctctgaatctaagctactcacagtctctgtcatggacttgtctcagatgtactctcctgtcttcgagtacttgtcaggtgacagacaagtagaagagtggcccaaggcaacctgtacaggtgactgcccagagagatgtggctgtacatcatcaacctgtttgcataaagaatggccccattcaagaaactggaggtgtaatcccacttggtgctggggggtagggactggctgcacctgttgtggtttagatgtgaaagacctttttacagactatatgtttgtcaagtggaaagtcgaatacattaagacagaggccatagtgtgtgtagaacttaccagtcaggaaaggcagtgtagcttaattgaggcgggtacaaggttcaatttaggtcccgtgaccatcacattgtcagaaccgaggaacatccaacaaaaactccctcctgaaataatcacactgcatcctaggattgaagaaggtttttttgacctgatgcatgtacaaaaggtgctgtcagcaagcacagtgtgtaagttgcagagttgcacacatggtgtgccaggagatctacaggtctaccacatcggaaatttactaaaaggagataaagttaacggacacctaattcataaaattgaaccacacttcaacacttcttggatgtcttgggatggctgtgacctagactactactgcaacatgggagattggccttcttgcacatataccggggttacccagcacaatcatgcttcatttataaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggactaaagtttgcaagcttgacttgtacaggttgttatgcttgtagttccggtatctcctgtaaagttaggattcatgtggatgaaccagatgaacttacagtacatgttaaaagtgatgatccagatgtagttgctgctagctcaagtctcatggcaaggaagcttgaatttggaacagacagtacatttaaggctttctcagccatgccaaaaacctccttatgtttctatattgtcgaaagggaatactgcaagagctgcagtaaagaagacacacaaaaatgtgttaacacgaagcttgagcatccacagagcattttgatcgaacataagggaactataatcggaaagcagaacaatacctgcacagcaaagacaagttgctggttagagtcagttaagagtttcttttatggtttaaagaacatgcttagtggcattttcggcaacgtttttgtaggcattttcttatttcttgcccccttcatcttgctaatacttttctttatgtttgggtggaggatcctattttgcttcaagtgctgtagaagaaccagaggcctgtttagatataaacatctcgaagacgatgaagaaactggttacagaagaatcattgaaagactgaacaacaaaaaaggaaaaaacaagctgcttgatggtgaaagacttgctgatagaagaattgccgaactattctccacaaaaacacacattggctaa

SEQ ID NO: 3544 - RNA, 5070 nt, synthetic construct
  misc_feature 1..5070: note = derived and/or modified CDS sequence (wt) from CCHFV(K128_76)__KX013454.1__GP
  source 1..5070: mol_type = other RNA
atgcctattagcgtcatgcacatatcgttgatgtgtgcagttctttgcctgcagctgtatggtctggggggaactcatgggtcacacaatgaaaccgaacacaacaaaacaaacgccgtgacaacgtccagtgacagccagagcccagaaccaccaacaagaacgaccctgcccgtcacgccagactcccccaccgtcacacccacaactccagccagcgcaccagaaggctcaggggaagtccacacatcccccccaaacaccactgagggcccgtctctgccggagtccacgccagagccccccacggcaaccagcacaggcatcccaagtgcaagtgatgtcaactccagcacacaggcagccagagacacctccacaccaacagtccacaccagtccacccaacagccccagcacaccacccacactacaagaaacacaccatcctatgaggaacttactttcagtcacgagccataagcctgaagaaacatcagcaccgtcagaatctggcaaagagagtccagcagccaacagccctcacccagtcgccgacagaccatcaacctcctccacaacagcccaaggacctactgaaaacaacagctacaacaccaccgaacagcttgagtccttgacacagtcgacaactctaggcccaatgacctctctaacacagacagtcctctcacagagtgtcacctccatagccgttcaagacacacacctcagcccaacgaacagatccaaaagaaaccttgaaatggaaataatcttaactttacctcagggtttaaaaaaatactatggcaaggtgctcaggcttctgcaactcaccttagaagaagacactgagggcctgttagaatggtgtaagagaaatcttgatcttgactgtgatgacactttctttcaaaagaggattgaagaattcttcataactggtgagggttatttcaatgaagttttacaatttagaacaccaggcacattgagcaccacagagtcaacacatgctgggttaccaacggctgaaccctttaaatcctatttcgctaaaggcttcctttcaatagactcaggttacttctcagccaaatgttactcaagaacatctaattcagggcttcagctgatcaatgtcactcgacattcaactagaatagctgacacacctgggcccaagatcaccaacctaaagaccatcagctgcataaacttaaaggcatcagtctttaaagaacatagagaggttgaaattaatgtgcttctccctcaagttgcagtcaacctctcaaactgtcacgttacaatcaaatcacatgtctgtgactattctttagacattgacggaacagtgaagcttcctcacattcaccatgacggaacctttatcccaggaacttacaagatagtgatagacaggaaaaacaagctgaatgacagatgtaccttgttcaccaactgtgtgataaaaggaagagaagttcgtaaaggccaatcagttttgaggcagtataagacagagattaggattggcaaggcatcaactggttctaggagattgctttctgatgaatctggtgatgactgcatatcaaggactcagctgttgagaacagagactgcagagatccatggtgacaattatggtggtccgggtgacaagattaccatttgcaatggttcaactattgtagaccaaagactgggtagtgaactggggtgttacactatcaatagagtgaagtcattcaagctgtgcgaaaacagtgccacagggaagagctgtgaaatagacagtatcccagttaagtgcaggcagggttattgcctaaaaatcactcaagaaggaaggggccatgtgaaattatccaggggctcagaggttgtcttggatgcatgcgactcaagctgtgaagtaatgatacctaagggcacaggtgacattctagtagactgttcaggtgggcagcaacattttttgaaggacaacttgattgacctaggatgtcccaaaattccattgttgggcaaaatggctatttatatttgtagaatgtcgaatcaccccaaaacgaccatggctttcctcttttggttcagttttggctatgtgataacttgtatagtctgcaaagccattttttacttattaataattgttggaacactagggaagaggtttaagcagtatagagagttaaaaccccagacctgtaccatctgtgagacaactcctacaaatgcaatagatgctgaaatgcatgaccttaactgcagttacaacatatgtccctattgtgcatctagactaacctcagatgggcttgctaggcatgtaactcattgccctaagcggaaggagaaagtagaagaaactgaattgtacttgaacttagaaagaattccatgggttgtaagaaagctattgcaggtatcagagtccaccggtgtagcattaaaaagaagcagctggctgattgtgctgcttgtgctgtttgcagtttcattatcaccagttcaatcagcacccattagtcatgggaagacaattgaaacataccaggtcagggaggaatacacaagtatttgcctctttgtactgggaagcattttgtttattgtctcttgtctaatgaaagggctggttaacagtgttggcaacatcttcttccctgggctgtccatttgcaagacgtgctctataggtagtattaatggctttgaaattgagtctcataagtgctattgtagcttactttgttgcccttactgtaggcactgctctgctgatagagaaattcatcaactgcacttgagcatctgcaaaaaaagaaaaacaggaagtaatgtcatgcttgctgtttgcaagcgcatgtgtttcagagcaacaatggaagtgagcaacaaggccctatttatccgtagcatcatcaacaccacttttgttgtgtgcattttgatactagcagtctgtgttgttagcacttcagcagtagagatggaaagcctgccagctgggacctgggaaagagaagaagacctaacaaatttctgtcatcaggaatgccaggttactgagactgagtgcctctgcccttatgaagctctagtactcagaaggcccctgtttcaggacagtatagtcaaaggcatgaaaaacctgctaaactcaacaagtttagaaacaagcttgtcgattgaggcaccatggggggcaataaatgttcagtcaacctacaaaccagctgtgtcagctgcaaacatagcacttagttggagttcagttgaacacagaggtagtaagattttggtttcaggcagatcagaatcaattatgaagctggaagaaaggacaggaatcagctgggatcttggcgtagaagatgcctctgaatctaagctacttacagtctctgtcatggacttgtctcagatgtactcccctgtcttcgagtacttgtcaggtgacagacaagtagaagagtggcccaaggcaacctgtacaggtgactgcccagagagatgtggttgtacatcatcaacctgtttgcataaagaatggccccattcaagaaactggaggtgtaatcccacttggtgctggggggtagggactggctgcacctgttgtggtttagatgtgaaagacctttttacagactatatgttcgtcaagtggaaagttgaatatattaagacagaggccatagtgtgtgtagaacttaccagtcaggaaaggcagtgtagtttaattgaggcaggtacaaggttcaatttaggtcctgtgaccatcacattgtcagaaccgaggaacatccaacaaaagctccctcctgaaataatcacactgcatcctaggattgaagaaggtttttttgacctgatgcatgtgcaaaaggtgctgtcagcaagcacagtgtgtaagttgcagagttgcacacatggtgtgccaggagatctacaagtctaccacatcgggaatttactaaaaggagatagagttaacggacacctaattcataaaattgagccacactttaacacttcttggatgtcctgggatggctgtgacctagactattactgcaacatgggagactggccttcttgcacatataccggagttacccagcacaatcatgcttcatttgtgaacctgctcaacattgaaactgactatacaaaaagcttccattttcactctaaaagggttactgcacatggagacacaccacaattagatctgaaggcaaggccaaactatggcgcaggagagatcaccgtactggtagaggttgccgatatggagttacacacaaagaagattgaaatatcaggcctaaagtttgcaagcttgacttgtacaggttgttatgcttgtagttccggtatctcctgtaaagttaggattcatgtggatgaaccagatgaacttacagtacatgttaaaagtgatgatccagatgtagttgcagctagctcaagtctcatggcaaggaagcttgaatttggaacagacagtacatttaaggctttctcagccatgcccaaaacctccttatgtttctacattgtcgaaagggagtactgcaagagctgcagtaaagaagacacacaaaaatgtgttaacacaaaacttgagcagccacagagcattttaatcgaacataagggaactataatcggaaagcaaaacaatacctgcacagcaaagacaagttgctggttagagtcagttaaaagtttcttttatggtttaaagaacatgcttagtggcatttttggcaatgtttttgtgggtattttcttatttcttgcccccttcatcttgctaatacttttctttatgtttgggtggaggatcctgttttgcttcaagtgctgtagaagaaccagaggcctgttcagatataagcatctcgaaaacgatgaagaaactggttacagaagaatcattgaaagactgaacaacaaaaaaggaaaaaacaagctgcttgatggtgaaagacttgctgatagaagaatcgccgaactattctccacaaaaacacacattggctaa

SEQ ID NO: 3545 - RNA, 5070 nt, synthetic construct
  misc_feature 1..5070: note = derived and/or modified CDS sequence (wt) from CCHFV(Hodzha)__KX013448.1__GP
  source 1..5070: mol_type = other RNA
atgcctgttagcattatgcatatattattgatgtgtgcagtactttgcctgcagcagtatggtctgggggagactcatagaccaaacaacggaaccgaacacaacaaaacaaacgttttgacaacgcccagcgacaaactgagccctgaaccgccagtaagcacagccttgtctgttacgccagactcctccactgtcacacccacaacaccagtcagtggactggaaggctcgggggaagtgtacacatcccccccagtcaccaccaagggcctgtctccgtcgaaggccacgtcagagctccccgcgacaactggcatagacacctcaagtgcaagtgatgtcgattccagcacacaggcagccagagacacctcaacactaacagtccgcacaagtccacctagcagccctagcacaccacctacatcacaagatacataccatcttgtgaggaatctactttcagtcacgagccccaggccagaagaaacaacagcaccgtcaaaatcaggcaaagagagtccagtagccaacagccctcacccagtcaccagcagaccatcatcccctcccataacagtccaaggacccactgaaaacagcagccacaacaccaccggacagcttgagtccatggcacaatcaacaaccctagtcccaatggcctctccaacacagacagtcctctcacagagtgtcacctccttagccgttcaagatgcacaccccagcccaacaaacaggtctaaaagaaaccttgaaatggagataatcttaactttacctcagggtttaaaaaaatactatggtaaggtgctcaggcttttgcaactcaccttagaggaggacactgaaggcctgctagaatggtgtaagagaaatcttggtcttgattgtgatgatactttctttcaaaagagaattgaagaattcttcataactggtgagggtcatttcaatgaagttttacaatttaaaacaccaagcacattgagcaccacagagtcaacacatgctgtgtcaccaacagctgaaccctttaaatcctatttcgccaaaggcttcctttcaatagattcaggttacttctcagccaaatgttattcaaaaacatctaattcagggcttcagttgatcaatgtcactcgacattcaactagaatagctgacacacctgggcccaagattaccaacctaaaaaccatcagctgcataaatttgaaggcatcagtcttcaaagaacatagagaggttgaaatcaatgtgcttctccctcaagttgcagtcaacctctcaaactgtcacgttactatcaaatcacatgtctgtgactattctttagacgttgatgggacagtgaggcttcctcacatccatcatggaggaaccttcattccaggaacttacaagatagtgatagacaaaaaaaacaagctgaatgacagatgtaccctatacaccaactgtgtgataaaagggagagaagttcgtaaaggccaatcaattttgaggcagtataagacagagattaggattggcaaggcatcaactggttctagaagactgctttctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcgaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctgagacaaccatggctttcctcttttggttcagtttcggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtcatgggaagacaattgaaacataccaggccagggaagaatacacaagtatttgcctctttgtactgggaagcatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgccctgctgatagagaaattcatcagctgcacttgagcatctgcaaaaaaaggaaaacaggaagtaatgtcatgctcgcagtctgcaagcgcatgtgcttcagagcaactatggaagtgagcaataaggccctacttatccgtagcatcatcaacaccacttttgttgtgtgcatattgatattagcagtctgtgttgttagcacctcagcggtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagttaaaggcaagaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaggcaacctgcacaggtgactgctcagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggagataaagtgaacggacacctaattcataaaattgagccgcacttcaatacttcctggatgtcctgggatggctgtgacctagactactactgcaacatgggagactggccttcttgcacatataccggagttactcaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggcctcaaatttgcaagcctgacttgcacaggttgttatgcttgtagttcaggcatctcctgcaaagttaggattcacgtggatgaaccagatgagctaacagtacatgttaaaagtgatgatccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacaaaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggctag

SEQ ID NO: 3546 - RNA, 5070 nt, synthetic construct
  misc_feature 1..5070: note = derived and/or modified CDS sequence (wt) from CCHFV(Hy13)__AY900145.1__GP
  source 1..5070: mol_type = other RNA
atgtctttcagcattatgtacacaccacttttgtgtgctgttctttgcttacagctgtggagtttagaagggtctcatggactgtccaacaaaacccaacacagtaatacaagcaccacaaaggcgcctgaagtaagccaggaatttggattgcctgtgagcacagtatcgactatcacgtcagaccctccttccatcacatccgcagtatcagtcagtggatcagaaggctcaggagacacgaacacctctccctcggtcaccacacaaggcctgactttgccagaaaccacgctggaactccttacaacaaccgacacagatgcatcaagcactgtcgtcgtcgatgtcagcacacagacggtcaaggacacccccatatcaacaacccacacaagtttgcccagtactcctagcgcgacaactacaccacagggtacacaccatactgcaaggggtctactgtcagtcaccagcacaaagccagaaggagcatcaacacaagcaaatccagaaaaaataagcatggagaccaatagcccgcgcctagccatcagcgagacaccatccttctctccaacaactcaggctcctaccgaaaacagcaaccccatcacatccaaacagctcatattctcagcacaaccagtaaccccaaacccagtgacccctccagtacagccagccctctctcagagtgacacgtccacggccatccaggatatacaccccagcccaacaagcagatctaagagaaaccttgagatggaaataattttgactttatctcagggtttgaagaagtactacggcaagatactaaaacttctggaccttactttggaagaagacactgaaggcctgctagagtggtgcaagagaaatcttggtttggtctgtgatgctgacttctttcagaagagaatagaagagttttttttgactggggagggtcacttcaatgaagtcttacagttcaaaacaccaagcacactaagccccacgggaccagcccgaactgggtcaccaacagtggaaccttttaaatcctacttcgctaaagggtttctttcaatggactcaggctacttctctgccaagtgttatccaagagcatccaattcaggacttcagctgatcaacgtcacccaacattcaactagaataacagacacacctggacccaaggtcactaatctgaagaccatcaattgcataaacttaaaggcatcagtctttaaagagcatagagagattgaaatcaatgttcttctccctcaagtcgcagttaacctctcaagctgccacgtgttgatcaaatcgcatgtctgtgactactctttggacattgatgggccagtaaggctaccccgcatccaccatgaaggaactttcataccaggaacttacaaattagttatagacaaaaaaaacaaacaaaatgacagatgcactttgatcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtatcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggttcgtccatttgtaagacatgttctattggcagcataaatggctttgagattgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagccactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagatcacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggagactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcttatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggctaa

SEQ ID NO: 3547 - RNA, 5070 nt, synthetic construct
  misc_feature 1..5070: note = derived and/or modified CDS sequence (wt) from CCHFV(SPU415/85)__DQ211635.1__GP
  source 1..5070: mol_type = other RNA
atgcccgtcaacattatgtacacaccactagtgtgtgctgttatctgcctacagctgtggaatctaggaggtactcttgtgttcatcaacaggacccaacacaatgaaacaggcaccgtggcaacacccgaaggaaccctgagacctaggctgcctgtgagcacagcactgcccaccaagtcggaccgcccttctgtcggacccgcagcatcgtccagtggactagagggctcaggggaaccgaatacctccccctcaatcaccacaaaaggcctgaccccgccagagaccacgccagcactccccacagcaaccgacacagatgcatcaagcacaggggtcgtcgatgtcagcacgcagatgaccaaggacatccctatgtcgacggcctacacgaatccacccagcacccctagcgcaccatctacaccacaaggcacacatcacactgcaaggggcctactgtcagtcgctagtacgaagtcagaagaagtatcaatgtcaacaagcccagcaaaaacaagcacagagaccagcagcccacccccagccaccagcgagacaccaaccccctctccaacaactcaggtccccaccggaaacaataaccctaacacctccagacaacctacgccctcagcacagccagcaatgtcaaacccagcaacttctccagcacagccaaacctttcacagagtgccccccccactgctgatcaaggcgtacaccccagcccaacaaacagatccaagaggaaccttgaaatagaaataattttaactttatctcaaggtctgagaaagtactatggcaagatactgaagcttctggaccttaccttagaagaggacactgaaggcctgctagaatggtgtaaaagaaatcttggtctaacctgtgatgataacttctttcagaagagaatagaagagttttttttgactggtgagggttacttcaatgaagtcttacagttcaaggtaccaagcacactgagctccacagagccgactcataccaggccaccaacagttgaacccttcaaatcctacttcgctaaaggcttcctttcaatgaactcaggctacttctctgccaaatgttatccaaggacatctaactcgggacttcagttgatcaatgtcaccaaacattcagctaaaatagcagacacacctggacccaagattactaatttgaagaccatcaattgcataaacttaagggcatcagtcttcaaagaacatagagaggttgagatcaatgtacttctccctcaagttgcagtcaacctctcaaactgccacgcacaaattaaatcgcatgtctgtgactactctttagccactgatgggatggtgagattacctcatatccaccatgaagggactttcataccaggaacttacaaaatagtgatagacaaaaaaaacaagcaaaacgataggtgtaccttggtcacaaattgtgttataaagggaagggaagttcgtaagggccagtctgcattaagacaatacaagacagaaattaggattggcaaggcatcttctggttccagaagactgctgtccgaggagtctgatggtgactgtatatcaagaactcaactattgaggacagagactacagaaatccacagtgacaactatggtggcccaggtgacaaaataactatctgcaatggttcaactattgtagatcaaagactaggcagtgaactggggtgttatactatcaatagggtgaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcggaaattgtcttggacgcttgcgattcaaactgtgaaataatgataccaaagggcaccggagacatcttagttgactgttcaggtggacaacaacatttcttaaaagataatttgattgatcttggatgtcccaatatcccattattaggcaaaatggccatctacatttgcagaatgtccaatcatcctaaaacaaccatggcctttctcttttggtttagctttggttatgtgataacctgtatactttgtaaggtgatcttttacctattgatagttgcagggacagtaggaaaaaagttcaaacagtatagagagttgagacctcagacctgcaccatatgtgaaacaattcctgtcaatgcaatagatgctgaaatgcatgacctcaactgcagttacaatatatgtccgtattgcgcatctagattaacctcagatggtcttgccagacatgtaatgcaatgccctaagcggaaggaaaaagtagaggaaactgaattatacttaaacctagaaaggattccctgggttgttaggaaattattgcaagtttcagagtctaccggtgtggcattgaagaggagcagttggctgacagtgctgcttgtgttgcttatagtctcattgtcaccggtgcagtcagcacctattggtcatggaaagacaattgaaacatatcaggccagagaagggtacacaagcttctgcctttttatactaggaagcatcttgtttgtagtctcttgcctagtaaagggtctaattgacagtgtcggtaacagctttttccctggattgtccatttgcaagacatgctcgattggcagtataaatggttttgagattgaatcccacaaatgttactgtagtctattttgttgcccttattgtagacactgctctgccgatagagaaatccataagttgcacttgagcatctgcaaaaaaagaaaaactgggagcaatgtcatgttggccgtctgcaagcgcatgtgctttagagcaaccatagaagttagcaatagggctctacttatccggaatatcatcaatactacttttgttgtgtgtatactgacactagcagtttgtgttgtcagcacctctgcagtggagatggaaagtctaccagccggcacttgggagaaagaggaagacctaacaaacttctgtcatcaggaatgccaagtcactgagactgaatgcctctgtccttacgaagcccttgtactcagaaaacccttatttttagacagtattgttaaaggcatgaagaacttgctaaactcaacaagcttggaaacaagcttatcaattgaggcaccatggggtgcaataaatgtccaatcaaccttcaaacccactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacaaatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtgggctagatgtaaaagacctctttacagattacatgtttgtcaagtggaaagttgaatacataaaaacagaggccatagtgtgtgtcgaacttactagccaagaaaggcaatgtagcttgattgaagcaggcacaagattcaatttaggtcctgtgactatcacattatcggagccaagaaacattcagcaaaagctccctccagaaataattacattgcatcctagaattgaagaaggcttttttgacttaatgcatgtgcaaagagtgctgtcagcaagcacagtgtgcaagctacagagttgcacacatggtgtgccaggagacctacaggtctaccacatcggaaacttgttaaaaggagacaaggtaaacgggcatctgattcacaagattgaaccacatttcaacacttcctggatgtcttgggatggctgtgacctagattactactgcaatatgggggattggccttcttgcacatacactggagtaacccaacataaccatgctgcatttgtaaatttgctcaatatcgaaaccgattatacaaaaaactttcattttcactccaagagagttactgcacatggagacacaccacaattagacttgaaggccagaccaacttatggtgcaggggaggttactgtactagtggaggttgctgacatggagctgcacacaaagaaaattgagatatcaggcttgaagtttgcaagtctaacttgcacaggctgctatgcttgtagctctggtatctcctgtaaggtcaagatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttatattgtggagagagaatactgtaagagctgcagtagagaggacacacgaaaatgtgttaacactaagcttgatcgaccacagagcattttgatcgaacataaaggaacgattattggaaagcaaaacaacacatgcacagctaaagcaagctgctggctagagtcagtcaaaagttttttctacggattgaagaatatgcttagtggcattttcggtaatgttttcatagggattttcttattcattgctccttttgtcctgttaatacttttctttatgtttgggtggaggatcctgttctgctttaagtgctgcagaagaaccagaggcctatttaagtacagacacctcaaggacgatgaagaaaccggttacaggaaaatcattgagaggctaaataacaaaaagggaaaaaacaaactacttgatggggaaaggctagctgataggaaaatcgccgagttattctccacaaaatcacatatcggctaa

SEQ ID NO: 3548 - RNA, 5070 nt, synthetic construct
  misc_feature 1..5070: note = derived and/or modified CDS sequence (wt) from CCHFV(SPU97/85)__DQ211633.1__GP
  source 1..5070: mol_type = other RNA
atgaccgtcaacactgtgtgcacaccactagtgtgtgctgttttctgcctacagctgtggaatctaggaggtactcttgtgcccactaacaggacccaacacaataaaacaggcaccatggcgacacccgaaggaaccctgggacccaggctgcctgtaagcacagcactgcccaccaagtcggaccgcccctctgtcggacccgcagcaccgtccagtggactagagggctcaggggaaccgaatacttccccctcaatcaccacaaaaggcctggccctgccagagaccacgccagcaccccccacagcaaccgacacagatgcatcaagcacaggggtcgtcaatgtcagcacgcagatgaccaaggacatccctatgtcgacggcctacacgaatccacccagcacccctagcgcaccatctacaccacaaggcacacatcacactgcaaggggcctactgtcagtcgccagtacgaagtcagaagaagtatcaatgtcaacaagcccaggaaaaacaagcacagagaccagcagcccacccccagccaccagcgagacaccagccccctctccaacaactcaggctcccaccggaaacaataaccctaacacctccagacaacctacgccctcagcacagccagcaatgtcaaacccaacaacctctccagcacagccaaaccttttacagaatgccccccccactgctgatcaaggcgtacaccccggcccaacaaacagatccaagaggaaccttgaaatggaaataattttaactttatctcaaggtttgagaaagtactacggcaagatactgaagtttctggaccttaccttagaagaggacactgaaggcctgctagaatggtgtaaaagaaatctcggtctaacctgtgatgataacttctttcagaagagaatagaagagttttttttgactggtgagggttacttcaatgaagtcttacagttcaaggtaccaagcacactgagctccacagagccgacccataccgggtcaccaacagttgaacccttcaaatcttacttcgctaaaggcttcctttcaatgaactcaggctacttctctgctaaatgttatccaaggacatccaactcgggacttcagttgatcaatgtcaccaaacattcagctaaaatagcagacacacctggacccaagattactaatttgaagaccatcaattgcataaacttaagggcatcagtcttcaaagaacatagagaggttgagatcaatgtacttctccctcaagtcgcagtcaacctctcaaactgccacgcacaaattaaatcgcatgtctgtgactattctttagccactgatgggatggtgagattacctcgtatccaccatgaagggactttcataccaggaacttacaaaatagtgatagacaaaaaaaacaagcaaaacgataggtgtaccttggtcacaaattgtgtgataaagggaagggaagttcgtaagggccagtctgcattaagacaatacaagacagaaatcaggattggcaaggcatcttctggttccagaagactgctgtccgaggagtctgatggtgactgtatatcaagaactcaactattgaggacagagactgcagaaatccacagtgacaactatggtggcccaggtgacaaaataactatctgcaatggttcaactattgtagatcaaagactaggcagtgaactggggtgttatactatcaatagggtaaagtcatttaagctttgcgaaaacagtgccacaggaaaatcttgtgaaatagatagcaccccagttaagtgcagacaaggtttttgcttgaaaatcactcaagaagggaggggccacgtgaagctgtcgagaggctcagaaattgtcttggacgcctgcgattcaagctgtgaaataatgataccaaagggcaccggagacatcttagttgactgttcaggtggacaacaacatttcttaaaagataatttgattgatcttggatgtcccaatatcccattattaggcagaatggccatctacatttgcagaatgtccaatcatcctaaaacaaccatggcctttctcttttggtttagctttggttatgtgataacctgtatcctttgtaaggtgatcttttacctattgatagttgcagggacagtagggaaaaagttcaaacagtatagagagttgagacctcagacctgcaccatatgtgaaacaactcctgtcaatgcaatagatgctgaaatgcatgacctcaactgcagttacaatatatgtccttattgcgcatctagattaacctcagatggtcttgccagacatgtaatgcaatgccccaagcggaaggaaaaaatagaggaaactgaattatacttaaacctagaaaggattccctgggttgttaggaaattattgcaagtttcagagtctaccggtgtggcattgaagaggagcagttggctgacagtgctgcttgtgttgcttatagtttcattgtcaccggtgcagtcagcacctattggtcatggaaagacaattgaaacatatcaggccagagaggggtatacaagcttctgcctttttatactaggaagcatcttgtttatagtctcttgcctagtaaagggtctgattgacagtgtcggtaacagcttcttccctggactgtccatttgcaagacatgctctattggcagtgtaaatggttttgagattgaatcccacaaatgttactgtagtctattttgttgcccttattgtagacactgctctgccgatagagaaatccataagttgcacttgagcatctgcaaaaaaagaaaaactgggagcaatgtcatgttggccgtctgcaagcgcatgtgctttagagcaaccatagaagttagcaatagggctttacttatccggagtatcatcaataccacttttgctgtgtgtatactaacactagcagtttgtgttgtcagcacctctgcagtggagatggaaagtctaccagccggcacctgggagagagaggaagacctaacaaacttctgtcatcaggaatgccaagtcactgagactgaatgcctctgtccttacgaagcccttgtactcagaaaacccttatttttagacagtattgttaaaggcaagaagaacttgctaaactcaacaagcttggaaacaagcttatcaattgaagcaccatggggtgcaataaatgtccaatcaaccttcaaacctactgtgtcagctgcaaacatagcacttagctggagctcagtggaacacagaggcaacaagattttggtttcaggcaggtcagaatcaatcatgaagctggaggaaaggacaggaatcagctgggatctgggagtagaagacgcctctgagtccaaattgctcaccgtctctgtcatggacttgtcacagatgtattcccccgtctttgagtacctgtcaggtgatagacaggtagaagagtggcccaaggcgacctgtacaggcgattgcccagaaagatgtggctgcacatcatcaacctgtttgcacaaggaatggccccattcaaggaactggagatgcaaccccacttggtgttggggggtcggcactggatgcacctgttgtggactagatgtaaaagacctctttacagattacatgtttgtcaagtggaaagttgaatacataaaaacagaggccatagtgtgcgtcgaacttactagccaagaaagacaatgtagcttgattgaagcaggcacaagattcaatttaggtcctgtgactatcacattgtcagagccaagaaacattcagcaaaagctccctccagagataatcacattgcatcctagaattgaagaaggcttttttgacttaatgcatgtgcaaaaagtgctgtcagcaagcacagtgtgcaagctacagagttgcacacatggtgttccaggagacctacaggtctaccacatcggaaacttgttaaaaggagacaaggtaaacgggcatctgattcacaagattgaaccacatttcaacacttcctggatgtcttgggatggctgtgacctagactactactgcaatatgggggactggccttcttgcacatacactggagtaacccaacataaccatgctgcatttgtaaatttgctcaatatcgaaaccgattatacaaaaaactttcattttcactccaagagagttactgcacatggagacacaccacagttagacttgaaggccagaccaacttatggtgcaggggaggtcactgtactagtggaggttgctgacatggagttgcacacaaagaaaattgagatatcaggcttgaagtttgcaagcctatcttgcacaggctgctatgcttgtagctctggtatctcctgtaaggtcaggatccatgtagatgaaccagatgagcttacagtacatgtgaagagtgaagacccagacatagttgctgcaggctcaagtctcatggcaaggaagcttgaatttggggcagatagtacattcaaagccttttcagccatgcccaaaacctccttgtgcttttacattgtggagagagaatactgtaagagctgcagtagagaagacacacaaaaatgtgttaacactaaacttgagcgaccacagagcattttgatcgaacataaaggaacgattattggaaagcaaaacgacacttgcacagctaaagcaagctgctggctagagtcagtcaaaagttttttctacggattaaagagtatgcttagtggcatttttggcaacgttttcatagggattttcttattcattgctccttttgtcctgttaatacttttctttatgtttgggtggaggattctgttctgctttaagtgctgcagaagaaccaggggcctatttaagtacagacacctcaaggacgatgaagaaaccggttacaggaaaatcattgagaggctaaataacaaaaagggaaaaaacaaactacttgatggggaaaggctagctgacaggaaaatcgccgagttattctccacaaaatcacatatcggctaa

SEQ ID NO: 3549 - RNA, 5070 nt, synthetic construct
  misc_feature 1..5070: note = derived and/or modified CDS sequence (wt) from CCHFV(C-68031)__DQ211629.1__GP
  source 1..5070: mol_type = other RNA
atgtctttcagcattatgtacacaccacttttgtgtgctgttctttgcttacagctgtggagtttagaagggtctcatggactgtccaacaaaacccaacacagtaatacaagcaccacaaaggcgcctgaagtaagccaggaatttggattgcctgtgagcacagtatcgactatcacgtcagaccctccttccatcacatccgcagtatcagtcagtggatcagaaggctcaggagacacgaacacctctccctcggtcaccacacaaggcctgactttgccagaaaccacgctggaactccttacaacaaccgacacagatgcatcaagcactgtcgtcgtcgatgtcagcacacagacggtcaaggacacccccatatcaacaacccacacaagtttgcccagtactcctagcgcgccaactacaccacagggtacacaccatactgcaaggggtctactgtcagtcaccagcacaaagccagaaggagcatcaacacaagcaaatccagaaaaaataagcatggagaccaatagcccgcgcctagccatcagcgagacaccatccttctctccaacaactcaggctcctaccgaaaacagcaaccccatcacatccaaacagctcatactctcagcacaaccagtaaccccaaacccagtgacccctccagtacagccagccctctctcagagtgacacgtccacggccatccaggatatacaccccagcccaacaagcagatctaagagaaaccttgagatggaaataattttgactttatctcagggtttgaagaagtactacggcaagatactaaaacttctggaccttactttggaagaagacactgaaggcctgctagagtggtgcaagagaaatcttggtttggtctgtgatgatgacttctttcagaagagaatagaagagttttttttgactggggagggtcacttcaatgaagtcttacagttcaaaacaccaagcacactaagccccacgggaccagcccgaactgggtcaccaacagtggaaccttttaaatcttacttcgctaaagggttcctttcaatggactcaggctacttctctgccaagtgttatccaagagcatccaattcaggacttcagctgatcaacgtcacccaacattcaactagaataacagacacacctggacccaaggtcactaatctgaagaccatcaattgcataaacttaaaggcatcagtctttaaagagcatagagagattgaaatcaatgttcttctccctcaagtcgcagttaacctctcgagctgccacgtgttgatcaaatcgcatgtctgtgactactctttggacattgatgggccagtaaggctaccccgcatccaccatgaaggaactttcataccaggaacttacaaattagttatagacaaaaaaaacaaacaaaatgacagatgcactttgatcaccaactgtgtaataaaaggaagggaaattcgtaagggccagtcagtgttaagacaatacaggacagaaatcaagattggcaaggcatcttctggttccagaagactattgtccgaagagtctggtgatgactgcatatcaagaactcagctatcgaggacagagactgcggaaattcacagtgataactatggtggtccaggtgacaagataaccatctgcaatggttcaactattgtagatcagagattgggcagtgaactagggtgttacactatcaatagagtaaagtcatttaagctttgcgagaacagtgccacaggtaaatcctgtgaaatagatagcaccccaattaaatgcaggcagggtttttgtttaaaaattactcaggagggaaggggccacgtgaagctatcaagaggttcagaagttgtcttggacgcctgtgattcaagctgtgagataatgataccaaagggcactggagacatcctagttgactgttcaggtggacagcaacatttcttaaaagataacttgattgatctgggatgcccaaacatcccactattaggtaagatggctatctacatttgtagaatgtcaaatcatcctaaaacgactatggcttttcttttttggtttagctttggttatgtgataacctgtatactctgtaaggtcatcttctacctattaatagttgtggggacgttgggaaaaaagttcaaacagtatagagagttgaaacctcagacctgtaccatatgcgaaacaactcctgttaatgcaatagatgctgaaatgcacgacctcaactgcagttacaatatatgtccttactgtgcatctaggttaacctcagacggtcttgccagacatgtaatgcagtgccctaagcggaaggaaaaagtagaagaaaccgaattatacttaaacttagaaagaatcccctgggttgttaggaaattactgcaggtgtcagaatccaccggtgtggcactaaagaggagtagttggctggttgtgctacttgtgttacttacagtttcattgtcaccagtacaatcagcacctatcggccatggaaagacagttgaaacatatcaaaccagagaagggtacacaagcatttgcctttttgtactaggaagcatcttatttatagtctcttgcctaatgaaggggttggttgacagtgttggtaacagttttttccctggtttgtccatttgtaagacatgttctattggcagcataaatggctttgagactgaatctcacaaatgttactgtagcctattttgttgcccctactgtagacactgctctgccgatagagaaatacataagttgcacttgagcatctgcaagaaaaggaagactgggagtaatgtcatgttggccgtctgtaagcgcatgtgctttagggcaactgtggaagtaagcaacaaggctctacttatccgaaacatcatcaataccacttttgttgtgtgcatactgatattagcagtttgtgttgtcagcacctccgcagtggagatggaaagcctgccagctggcacttgggagagagaggaagatctgacaaatttctgtcatcaagaatgccaagtcactgagactgaatgcctctgtccttacgaagctcttgtgctcaggaaacccttgttttcagacagtattgtcaaaggcatgaagaacttgctaaattcaacaagcttagaaacaagcttatcaattgaggcaccatggggagctataaatgtccaatcaaccttcaaacctactgtgtccgctgcgaacatagctcttagttggagctcagtggaacacaggggtaataagattttggtttcaggtagatcagagtcaattatgaagctagaggaaaggacaggaatcagctgggatctaggggtagaagatgcctctgagtctaaattgcttactgtctctattatggacttgtcacagatgtattctcctgtctttgagtacctatcaggtgatagacaagtggaggaatggcccaaggcaacctgcacaggagattgcccagaaagatgtggctgcacatcatcaacctgcctacacaaagaatggccccattcaagaaactggagatgcaaccccacctggtgttggggagtcggcactggatgtacctgctgtgggctggatgtaaaagacctttttacagattacatgtttgtcaagtggaaagttgagtacattaaaacagaagctatagtgtgtgttgagcttactagccaagagagacaatgtagcttgattgaggcaggcacaagattcaacttaggtcctgtgaccatcacattgtcagagccaagaaacattcagcaaaagctccctccagagatagttacattgcatcccagaattgaagaaggtttctttgatttaatgcatgtaaaaaaagtgctatcagcaagtacagtatgtaagctacagagttgcacacatggtgtgccaggggacctacaggtctaccacataggaaacttgttaaaaggagacaaggtgaatgggcacctgattcacaaaattgaaccacacttcaacacttcctggatgtcttgggacggctgtgacctagactactactgtaatatgggggactggccatcttgctcatatactggagtaacccagcacaatcatgctgcatttgtaaacatgctcaacatcgaaactgattatacaaaaatcttccactttcactctaagagagttactgcacatggagacacaccacaattagatttgaaagctagaccaacttatggtgcaggtgaaatcactgtgctagtggaagttgctgacatggagttacacacaaagaaaattgagatatcaggtttaaagtttgcaagcttaacttgcacaggctgttatgcttgtagctctggtatctcctgtaaggttagaatccatgtagatgagcctgatgagcttacagtacatgtgaagagtgaagacccagacatagttgctgctagctcaagtctcatggctagaaaacttgaatttgggacagatagcacattcaaagccttttcagccatgcccaaaacctccttgtgcttttacattgtggagagagaatattgtaaaagctgcagtaaagaagatacacaaaaatgtgtcaacacaaagcttgagcaaccacagagcattttaattgagcacaaaggaacgataattggtaagcaaaacgacacctgcacatctaaagcaggctgttggctagagtcagtcaagagcttcttttatgggctaaaaaacatgcttagtggcatttttggcaatgttttcatagggattttcttattccttgctccttttatccttttaatacttttctttatgtttggatggagaatcctgttctgctttaaatgttgcagaagaactagaggcctatttaagtacagacacctcaaggacgatgaagaaaccggttacaggaaaatcattgagaggctgaacaacaaaaaagggaaaaacaaactgcttgatggtgaaagattagctgataggaagattgctgagctgttctccacaaagacacacattggctaa

SEQ ID NO: 3550 - RNA, 5070 nt, synthetic construct
  misc_feature 1..5070: note = derived and/or modified CDS sequence (wt) from CCHFV(Baghdad 12)__AJ538197.2__GP
  source 1..5070: mol_type = other RNA
atgcctgttagcattatgcatatatcattgatatatgcagttctttgcttacagctgtatggtctgggggaaactcatggatcaagcagtggaactgaacacaacaggacaaacgttgtggcaacgcccggaggtagccagagccctgaaccgctagtgagcacgaccttgcccgtcacgctagactcctccactgtcacacccgcaacgcaagctagcggaccagaaggctcgggggaagtttacacatcccccccaaccaccactgaaggcctgtctccgtcagatgccacgtcagagctccccacaacaactggcataggcatctcaagttcaagtgatgtcaattccagcacacaggcagccggggacacctccacaccaacagcacgcacaagtctacctgacagccctagcacaccacccacatcacaagatacacaccatcccatgagaaatttactttcagtcacgagccttaagccagaagaaacaccagcaccgtcaaaatcaggcaaagagagtccagcagccagcagccctcacccagtcgccagcagaccaccaaccccttctacaacagctcagggacccaccgaaaacaacagccgcaacaccactgtacagcttaaatccgtgacacaatcggcaaccctaggcccaatggcctctccaacacagacagtccttctacagagtgtcacctccatagccattcaagacacacaccccagcccaacgaataggtctagaagaaaccttgaaatggagataatcttaactttacctcagggtttaaagaaatactatggcaaggtgctcaggcttttgcaactcaccctagaggaggacactgaaggcctgctagaatggtgcaagaggaatcttggtcttgattgtgatgatactttctttcaaaagagaattgaagagttcttcataactggtgagggtcatttcaatgaagttttacaattcagaacaccaggcacattgagcaccacagagtcaacacatgctgggtcaccaacagttgaaccctttaaatcctattttgctaaaggcttccttttaatagactcaggttacttctcagccaaatgttactcaagaacatctaattcagggcttcagttgatcaatgtcactcggcattcaactaaaatagctgatacacctgggcccaagattaccaacctaaagaccatcagctgcataaacttaaaggcatcaatcttcaaagaacatagagagattgaaatcaatgtgcttcttccccaagttgcagtcaacctctcaaactgtcacgttacaatcaaatcacatgtctgtgactattctttaaacattgatggaacagtgaagcttcctcacattcatcatgaaggaatctttattccaggaacttacaagatagtgatagacaaaaaaaataagctgaatgacagatgcaccctgttcaccaactgtgtgataaaagggagagaagttcgtaaaggccaatctgttttgaggcagtataagacagagattaggattggtaaggcatcaactggctctagaagattgctttctgaagaatctggtgatgactgcatatcaagaactcggctattgagaacagagactgcagagatccatggtgacagctatggtggtccgggtgacaaaattactatttgcaacggttcaactattgtagatcaaagactgggaagtgagatggggtgttacactatcaatagagtgaagtcattcaagctgtgcgaaaacagtgcaacaggaaagagctgtaaaatagacagtatcccagttaagtgcagacagggttattgcctaaaaatcactcaggaaggaaggggccatgtgaaattatccaggggctcagaggttgtcttggatgcatgcgactcaagctgtgaagtaatgatacctaaaggcacaggtgacatcttagtagactgttcaggtgggcagcaacattttttgaaggataacttgattgatctaggatgccccaacattccattattaggtaaaatggctatttatatttgcagaatgtcaaatcaccctaagacaaccatggctttcctcttttggttcagttttggttatgtgataacctgtatactctgcaaggccatcttctacttattaataattgttgggacactagggaaaaggtttaagcagtacagagagttaaaaccccagacctgtactatatgtgagacaactcctgtaaatgcaatagatgctgaaatgcatgaccttaactgcagttacaatatatgtccctattgtgcatctagattaacctcagatgggcttgctaggcatgtgacacaatgccctaagcggaaggagaaagtggaagaaactgaattgtacttgaacttagagaggattccctgggttgtaagaaagctgttgcaggtatcagagtccacaggtgttgcattaaagagaagcagctggctgattgtgctgcttgtgctacttgcagtttcatcatcaccagttcaatcagcacccatcggttatgggaagacaattgagacataccaggccagggagggatacacaagtatttgcctctttgtactaggaagtatcctgtttatagtctcttgtctaacaaaagggctggttgacagtattggcaacatcttcttccctgggctgtccatttgcaaaacgtgctctataggtagtatcaatggctttgaagttgagtctcataagtgctattgtagcttgctttgttgtccctactgtaggcattgctctgctgatagagaaatccatcagctgcacttgagcatctgcaaaaaaagaaaaacaggaagtagtgtcatgcttgcagtctgcaagcgcatgtgcttcagagcaactatggaagtgagcaataaggccctacttatccgtagcattatcaacaccacttttgttgtctgcatattgacactagcagtctgtgttgttagcacctcagcagtagagatggaaagcctaccagctgggacctgggaaagagaagaagacctaacaaatttctgtcatcaagaatgccaggtcacggagactgagtgcctctgcccttatgaagccctagtactcagaaagcccttgttcctggatagtatagtcaaaggcacgaaaaatctgctaaactcaacaagtttagaaacaagcttatcgattgaggcaccatggggagcaataaatgttcagtcaacctataaaccaactgtgtcaactgcaaacatagcacttagttggagttcagttgaacacagaggtaacaagattttggtttcaggcagatcagaatcaattatgaagctagaagagagaacaggaatcagttgggatcttggcgtagaagatgcctctgaatctaagctacttacagtctctgtcatggacttgtctcagatgtactctcctgtctttgagtacttatcaggtgacagacaagtagaagaatggcccaaggcaacctgtacaggtgactgcccagaaagatgtggctgcacaacatcaacctgcttgcataaagaatggccccattcaagaaactggagatgtaatcccacttggtgctggggagtgggaactggctgcacttgttgcggattagatgtgaaggacctttttacagattatatgttcgtcaaatggaaagttgaatacattaaaacagatgccatagtgtgtgtggaactcactagtcaagaaaggcaatgcagcttgattgaggcaggtacaaggtttaacttaggttctgtgaccatcacattgtcagaaccgaggaacattcagcaaaagctccctcctgaaataatcacattacatcctaggattgaagaaggtttttttgacctgatgcatgtacaaaaagtgttgtcagctagcacagtgtgtaagttgcagagttgcacacacggtgtgccaggtgatctacaggtctaccacatcggaaatttattaaaaggggataaagtgaatggacacctaattcataaaattgagccacattttaacacttcttggatgtcctgggatggctgtgacttagactactattgcaatatgggagactggccttcttgcacatataccggagttacccaacacaatcatgcttcatttgtaaacctgctcaacattgaaactgattacacaaaaagcttccactttcactctaaaagggttactgcacatggagatacaccacagttagatctgaaggtaagaccaacctacggcgcaggagaaatcactgtactggtagaagttgctgacatggagttgcacacgaagaagattgaaatatcaggcctaaaatttgcaagcctgacttgcacaggctgttatgcttgtagctctggcatttcctgcaaagttaggatacatgtggatgaaccggatgaactcacagtacacgtcaaaagtgatgatccagatgtagtagcagctagctcaagtctcatggcaaggaagcttgagtttggaacagacagcacatttaaagctttctccgccatgccaaaaacttccttatgtttctacattgtcgaaagggagtactgtaaaagctgcagtaaagaagatacacaaaaatgtgttaacacaaaacttgagcaaccacagagcattttgattgaacataagggaactataatcggaaagcaaaacaatacctgcacagccaaaacaagttgctggttagagtcagttaaaagtttcttttatggtctaaagaatatgcttagtggcatttttggcaattttttcatgggcatcttcttatttcttgccccctttatcttgttaatacttttctttatgtttggatggaggatcctgttttgctttaagtgttgcagaagaaccaggggcctgtttaagtacagacatctcaaagatgatgaagaaactggttatagaaggatcattgaaagactgaacaacaagaaagggaagaacaagctgcttgatggtgaaagacttgccgatagaaggattgccgaactattctccacaaaaacacatattggctag

SEQ ID NO: 3551 - RNA, 5070 nt, synthetic construct
  misc_feature 1..5070: note = derived and/or modified CDS sequence (wt) from CCHFV(Hodzha)__AY223476.1__GP
  source 1..5070: mol_type = other RNA
atgcctgttagcattatgcatatattattgatgtgtgcagtactttgcctgcagcagtatggtctgggggagactcatagaccaaacaacggaaccgaacacaacaaaacaaacgttttgacaacgcccggcgacaaactgagccctgaactgccagtaagcacagccttgtctgttacgccagactcctccactgtcacacccacaacaccagtcagtggactggaaggctcgggggacgtgtacacatcccccccagtcaccaccaagggcctgtctccgtcgaaggccacgtcagagctccccgcgtcttcaggcatagacacctcaagtgcaagtgatgtcgattccagcacacaggcagccagagacacctcaacactaacagtccgcacaagtccacctagcagccctagcacaccacctacatcacaagatacataccatcttgtgaggaatctactttcagtcacgagcccctggccagaagaaacaacagcaccgtcaaaatcaggcaaagagagtccagtagccaacagccctcacccagtcaccagcagaccatcatcccctcccataacagtccaaggacccactgaaaacagcagccacaacaccaccggacagcttgagtccatggcacaatcaacaaccctagtcccaatggcctctccaacacagacagtcctctcacagagtgtcacctccttagccgttcaagacgcacaccccagcccaacaaacaggtctaaaagaaaccttgaaatggtgataatcttaactttacctcagggtttaaaaaaatactatggtaaggtgctcaggcttttgcaactcaccttagaggaggacactgaaggcctgctagaatggtgtaagagaaatcttggtcttgattgtgatgatactttctttcaaaagagaattgaagaattcttcataacaggtgagggtcatttcaatgaagttttacaatttaaaacaccaagcacattgagcaccacagagtcaacacatgctgtgtcaccaacagctgaaccctttaaatcctatttcgccaaaggcttcctttcaatagattcaggttacttctcagccaaatgttattcaaaaacatctaattcagggcttcagttgatcaatgtcactcgacattcaactagaatagctgacacacctgggcccaagatcaccaacctaaaaaccatcagctgcataaatttgaaggcatcagtcttcaaagaacatagagaggttgaaatcaatgtgcttctccctcaagttgcagtcaacctctcaaactgtcacgttactatcaaatcacatgtctgtgactattctttagacgttgatgggacagtgaggcttcctcacatccatcatggaggaaccttcattccaggaacttacaagatagtgatagacaaaaaaaacaagctgaatgacagatgtaccctatacaccaactgtgtgataaaagggagagaagttcgtaaaggccaatcaattttgaggcagtataagacagagattaggattggcaaggcatcaactggttctagaagactgctttctgaagaatctggtgacgactgcatatcaagaactcagctactgaggacagagactgcagagatccatggtgatgattatggtggtccgggcgacaagattaccatttgcaatggttcaactattgtagatcaaagactaggtagtgaactggggtgttacactatcaatagagtgaagtcattcaagctgtgcaaaaacagtgcaacagggaagagctgtgaaatagacagcaccccagttaaatgcaggcagggttattgcctaaaaatcactcaggaaggaaggggccatgtgaaattatccaggggctcggaggttgtcttggatgcatgcgattcaagctgtgaagtaatgatacctaagggcacaggtgacatcctagtagactgttcaggtgggcagcaacattttttgaaagacaacttaattgatctaggatgtcccagaattccattattaggtaaaatggctatttatatttgcagaatgtcgaatcaccctaagacaaccatggctttcctcttttggttcagttttggctatgtgataacctgtatactctgcaaggccattttctacttattaataattgttggaacactagggaagaggttcaagcagtatagagagttaaaaccccagacctgtaccatatgtgagacaactcctgcaaatgcaatagatgctgaaatgcatgaccttaactgcagttacaacatatgtccctattgtgcatctagactaacctcagatgggcttgctaggcatgtgacacaatgccctaagcggaaggagaaggtagaagaaactgaattgtacttgaacttagagagaattccctggattgtaagaaagctgttgcaggtgtcggagtccactggtgttgcattaaaaagaagcagctggctgattgtgctgcttgtgctgttcgcagtttcattatcacctgttcaatcagcacccattggtcatgggaagacaattgaaacataccaggccagggaagattacacaagtatttgcctctttgtactgggaagcatcttgtttatagtctcttgtctgatgaaagggctggttgacagtattggcaacatcttcttccctgggctgaccatctgcaagacatgctctataggtagtatcaatggctttgaaattgagtctcacaagtgctattgtagcttactttgttgcccctactgtaggcactgctctgctgatagagaaattcatcagctgcacttgagcatctgcaaaaaaaggaaaacaggaagtaatgtcatgctcgcagtctgcaagcgcatgtgcttcagagcaactatggaagtgagcaataaggccctacttatccgtagcatcatcaacaccacttttgttgtgtgcatattgatattagcagtctgtgttgttagcacctcagcggtagagatggaaagcctaccagctgggacctgggaaagagaagaagacctaacaaatttctgtcatcaggaatgccaggttacagagactgagtgcctctgcccttatgaagcccttgtgctcagaaggcccctgttcctggatagtatagttaaaggcacgaaaaatctgttaaactccacaagtttagaaacaagcttgtcgattgaggcaccatggggggcaataaatgttcagtcaacctacaaaccaactgtatcaactgcaaacatagcacttagttggagttcagttgaacacagaggtaataagattttggtttcaggcagatcagaatcaattatgaagctggaagaaagaacaggaatcagctgggatcttggcgttgaagatgcctctgaatctaagctacttactgtctctgtcatggacttgtctcagatgtactcccctgtcttcgagtacttatcgggtgacagacaagtagaagagtggcccaaagcaacctgcacaggtgactgcccagaaagatgtggctgcacatcatcaacctgcttacataaagaatggccccattcacgaaactggagatgcaatcccacttggtgctggggggtggggactggctgcacctgttgtggattagatgtgaaagacctatttacagattatatgttcgtcaagtggaaagttgattacattaaaacagaggccatagtgtgtgtagaactcaccagtcaggaaaggcagtgtagcttggttgaggcgggcacaaggttcaatttaggtcctgtaaccatcacattgtcagaaccgaggaacatacaacaaaagctccctcctgaaataatcacattgcatcctaggattgaagaaggtttttttgacctgatgcatgtacaaaaagtgctgtcagcaagcacagtgtgtaaattgcagagttgcacacatggtgtgccaggagatctacaggtctaccacatcggaaatttattaaaaggggataaagtgaacggacacctaattcataaaattgagccgcacttcaatacttcctggatgtcctgggatggctgtgacctagactactactgcaacatgggagactggccttcttgcacatataccggagttacccaacacaatcatgcttcatttgtaaacctgctcaacattgaaactgactatacaaaaagcttccactttcactctaaaagggttactgcacatggagacacaccacaattggatctgaaggcaagaccaacctacggcgcaggagaaatcactgtactggtagaagttgctgatatggagttacacacaaagaagatcgaaataacaggccttaaatttgcaagcctgacttgcacaggttgttatgcttgtagttcaggcatctcctgcaaagttaggattcacgtggatgaaccagatgagctaacagtacatgttaaaagtgatgacccagatgtagttgcagccagctcaagtctcatggcaaggaaacttgagtttggaacagacagtacattcaaagctttctcagccatgcctaaaacttccttatgcttctacattgtcgaaagggagtactgtaagagctgcagtaaagaagacacacagaaatgtgttaacacaaaacttgagcaaccacagagcattttgatcgaacgcaagggaactataatcggaaagcaaaacaatacttgcacagccaaggcaagttgctggttagagtcagttaaaagtttcttttatggtctaaagaacatgcttagtggcatttttggcaatgtttttgtaggcattttcttatttcttgccccctttatcttgttaatacttttcttcatgtttggatggaggatcctgttttgcttcaagtgttgcagaagaaccaggggcctgtttaagtataaacatctcaaagacgatgaagaaactggttacagaaggatcattgaaagactgaacaacaagaaggggaaaaacaagctgcttgacggtgaaagacttgccgatagaaggattgccgaactattctccacaaaaacacacattggctag

SEQ ID NO: 3552 - RNA, 5067 nt, synthetic construct
  misc_feature 1..5067: note = derived and/or modified CDS sequence (wt) from CCHFV(Kosovo/9553/2001)__AY675511.1__GP
  source 1..5067: mol_type = other RNA
atgcccatcaacatcatgcatacactattagtgtgcttcattctttacctacagctgttgggtctaggaggagctcatggacagtcaaacgcaactgaacacaatggaacaaacaccaccacagcacccggcacaagtcaaagccccaagccacccgcgagcacaaccccatcacacgcaccggaatcatccaccatcaaactcaccacaccaacaagcgaaacagaaggctcaggggaaacgaccccacccacaagcaccacccagggctcgcccccactagagaccacaccagaacgctctacaacaaccgccacaagcacatcaggcacagacaacatgaactccaccacacagatgaccgacaacacccccacactaacagccagcacaagtccatccagcagccccagcacgccatccacatcacaaggcctgcattatccggtaaggagtctattgtcagtctcgagccctaagacagtaacaacaccaacaccaatgagccctggagagatgagctcggaaaccagcagtcagcactcagccatgagcagaacaccaaccccccacacagcaacccaggtctccactgagaacgccaaccgcagcacatccagacagtctgagtcctcagcacagccggcaacccaaagcccagtgacttccccagcgcaatcaatccttttgatgagtgctactcccacaaccattcagaacatacatcccagcccaacaaacaggtccaagaggaaccttgagatggaaataattttaactctgtctcaaggtctgaagaaatactatggtaaaatactgaagcttctgcaccttaccctggaagaggacactgaaggcttgttggaatggtgtaagagaaaccttgggtcgaactgtgatgatgacttctttcaaaagaggatagaagaattcttcataactggtgagggctacttcaatgaagtcctacagtttaaaacactaagcacaccaagccccacggagccgtctcatgccaggctaccaacagcggaacccttcaaatcttacttcgctaagggcttcctctcaatagattcgggttacttttctgccaaatgttatccaagatcatccacttcagggcttcagctgatcaatgttactcaacaccctgctaggatagcagagacacctgggcccaaaatcacgagtctgaaaaccatcaactgcatcaatctaagagcatctgtcttcaaagaacacagagaagttgaaatcaatgtgcttcttcctcaaattgcagtcaacctctcaaactgccatgttgtgatcaattcacatgtctgtgattactctttagacactgatgggccagtgaggcttcctcgcatttaccatgaagggactttcatgccaggaacttataaaatagtgatagacaggaaaaataagctaaatgaccgatgtacgctagtcaccaactgtgtgataaaggggagagaagttcgtaagggccaatcagtgctgaggcagtacaaaacagaaattaaaataggcaaggcaccaacaggctctaggaaactactgtccgaagagccaggtgatgactgcatatcaaggactcagctattgaggacagaaacagcagagatccatgacgataactatggtggtccaggtgacaaaataactatctgcaatggttcgaccattgtagatcagagactgggcagtgaactagggtgttataccatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgcttgcgactcaagctgtgaagtaatgatacccaaaggcactggagatatcctagtagactgctctggtggacagcagcatttcttaaaagacaacttgattgacctagggtgccctcatatcccactattgggtaagatggccatttacattgccagaatgtcaaatcatcctaaaacaaccatggcttttctcttctggttcagtttgggctatgtgatcacctgtatactttgcaaggctcttttttattcattgataattattgggacactagggaaaaaaatcaagcaatatagggaactgaaacctcaaacttgcaccatatgtgagacagctcctgtcaatgcaatagatgctgaaatgcatgacctcaactgtagttacaatatatgcccctattgtgcatcaagattgacctctgatgggctagctaggcatgtaaagcagtgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacccgttggtcatggtaagacaatcgaaacatatcagaccagagaaggattcacaagtatttgtctctttatgttaggaagcatcctattcatagtctcctgcttggtgaaagggctggttgacagtgtcagtgacagcttcttccctggcctgtctgtctgtaaaacatgctccattggcagtataaatggctttgaaattgaatcgcataaatgctactgtagcttgttctgctgcccctattgtagacactgctctgctgacagagaaattcaccaattgcacttgagtatctgcaaaaaaagaaaaacagggagcaatgtcatgctagctgtctgcaagcgcatgtgctttagagcaaccatagaagcaagcagaagagccctgctcatccgaagtattatcaataccacttttgtaatatgcattctaacattaacaatctgtgttgctagtacctctgcagtagagatggaaacccttccagcagccacctgggagagagaggaagacctgacaaatttctgtcatcaggaatgccaggtacccgagacggaatgcctttgcccatacgaagctcttgtgctcaggaaacctcttttcttagacagtatagtcaaaggtatgaaaaatttgctaaactcaacaagcttggaaacaagcttatcaattgaggcaccatggggagcaataaatgtccagtcaacctttaaaccaacagtatcgactgcgaacatagcactcagttggagctcagtggagcacagaggcaacaagatcttagtcacaggcaggtctgaatcaattatgaaactagaggaaaggacaggagtcagctgggatctaggggtagaagatgcctctgaatccaaattacttaccgtctctatcatggatttgtcacagatgtattccccagtttttgagtacttgtctggagacagacaggttgaagaatggcccaaagcaacttgtacaggtgactgcccagaaaggtgtggctgcacatcatcaacctgcttgcataaagaatggcctcattcaagaaactggagatgtaatcccacttggtgctggggagtgggaaccggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagcttccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgcttaacattgaaactgattacacgaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggcatctcctgtaaagtcaggattcatgtagatgaaccagatgagctcacagtgcatgtaaagagcagtgacccagatgttgttgcagctagcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagccgaatgatacttgcccagccaagacaagctgttggctagagtccgtcaagagctttttttatggattgaagaatatgcttggcagtgtctttggtaattttttcataggcattttgttattccttgccccttttttcctgtggatgctttcctttatgtttggatggaaaatcttgttctgctttaaatgttgcaggaggaccagaggcctgtttaagtatagacacctcaaagacgatgaggaaacaggctacagaaggattattgaaaggctgaacaacaaaaaagggaaaaatagactgcttgatggtgaaaggttggctgataggaaaattgccgagctgttttctacaaaaacacacattggctaa

SEQ ID NO: 3553 - RNA, 5067 nt, synthetic construct
  misc_feature 1..5067: note = derived and/or modified CDS sequence (wt) from CCHFV(200406546-Turkey)__KR864902.1__GP
  source 1..5067: mol_type = other RNA
atgcctactaacattacgcatacactattagtgtgcttcattctttacctacagctgttgggtcgaggaggagctcatggacagtcaaacgcaactgaacacaatggaacaaacaccaccacagcacccggcacaagtcaaagccacaagccacttgtgagcacaaccccaccacacacactggaatcatccaccatcaaacacaccacaccaacaagcgaaacagaaggctcaggggaaacgaccccacctccaaacaccacccagggcccgtccccaccagaggccacaccagaacgccctgcaacaaccgccacaagcacgccaagcacagacaacacaaattccaccacacagatgaacgacaacaaccccacatcaacaatcagcacaagtccatccagcagtcccagcacgccacccacgccacaaggcatacatcatcctgcaaggagtctactgtcagtctcaagcctcaagacagcaacaacaccaacaccaacgagccctggagagataagctcagaaaccagcagtcagcactcagccatgagcagaacaccaaccctccacacaacaacccaggtctccactgagagtactaaccacagcacaccaagacaatctgagtcatcagcacagccgacaaccccaagcccaatgacttccccagcacaatcaatccttccaatgagtgctgctcctacagctattcagaacatacatcccagcccaacgaataggtctaagaggaaccttgaggtggagataattttaactctatctcaaggtctaaagaaatactacggtaagatactgaagcttctgcacctcaccttggaagaggacactgaaggcctgttagaatggtgtaagagaaaccttgggtcaagctgtgatgacgacttctttcaaaagagaatagaagagttcttcgtgactggtgagggctactttaatgaagtcttgcaatttaaaacactaagcacactaagccccacggagccgtctcatgccaagctaccaacagtggaacccttcaaatcttacttcgccaagggcttcctttcaatagattcgggttacttctctgccaaatgttatccaagatcatctacttcagggcttcagctgatcaatgttacccaacatccagctaggatagcagaaacacctggacccaagacaacgagtctgaaaaccatcaactgtataaacttaagagcatcagtcttcaaagaacacagagaaattgagatcaatgtgcttcttcctcagattgcagtcaacctctcaaactgccatgctgtgatcaaatcacacgtctgtgattactctttagacactgatgggccagtgaggcttcctcacatttaccatgaagggacgttcataccaggaacttataaaatagtgatagataaaaaaaataagctaaatgaccgatgtatactggtcacgaactgtgtgataaagggaagagaggttcgtaagggccaatcagtgctgaggcagtacaaaacagaaatcaagataggcaaggcatcaacaggctctaggaaactactgtccgaagagccaggtgatgactgcatatcaagaactcagctattgaggacagaaacagcagagattcatgatgataactatggtggcccaggtgataaaataactatctgcaacggttcaactattgtagatcagagactgggcagtgaactagggtgttatactatcaacagggtgaagtcattcaagctatgcgaaaacagcgccacagggaaaacctgtgagatagacagcactccagttaagtgcaggcaaggtttttgtttaaaaatcacccaagagggaaggggccacgtaaaattatctagaggctcagaggttgtcttggacgtttgcgactcaagctgtgaagtaatgatacctaaaggcactggagatatcctggtggactgttcaggtggacagcaacatttcttaaaagacaacctaattgacctagggtgcccccatgtcccgctattgggtaggatggccatttacatttgcagaatgtcaaatcatcctagaacaactatggcttttctcttctggttcagctttggctatgtgatcacctgtatattttgcaaggctcttttttattcattgataattattgggacactagggaaaaagttcaagcagtatagggaactgaaacctcaaacttgtaccatatgtgagacggctcctgtcaatgcaatagatgctgaaatgcatgaccttaactgcagttacaatatatgcccttattgtgcatcaagattgacctccgacgggctagctaggcatgtgccacaatgccccaagcggaaagaaaaagttgaggagactgaactgtacttgaacctggagagaattccttggattgtcagaaagctattgcaggtgtcagagtccactggtgtggcattgaaacgaagcagctggctgattgtactgcttgtgttactcacagtttcgttgtcaccggttcaatcggcacctgttggtcatggtaagacaatcgaaacatatcagaccagagagggattcacaagtatctgtctctttatgttaggaagcatcctattcatagtctcttgcttggtgaaggggctagttgacagtgtcagtgacagcttcttccccggcctgtctgtctgtaagacatgctctattggcagtataaatggctttgaaatcgaatcgcataaatgctactgtagcctattttgctgcccctactgtaggcactgctctgctgacagagaaattcaccagttacacttgagtatctgcaaaaaaagaaaaacggggagcaatgtcatgctggctgtctgcaaacgcatgtgctttagggcaaccatagaagcaagcagaagagccctactcatccgaagcattatcaatactacttttgtaatatgcattctaacattgacaatctgtgttgttagcacctctgcagtagagatggaaaaccttccagcaggcacctgggagagagaggaagacctgacaaatttctgtcatcaggaatgccaggtgaccgagacggagtgcctctgtccatacgaagctcttgtgctcagaaaacctctgttcttagacagtatagttaaaggcatgaaaaatttgctaaactcaacaagcttagaaacaagtttatcaattgaggcaccatggggagcaataaatgtccagtcaacctttaaaccaacagtatcgactgcaaatatagcactcagttggagctcaatagagcacaggggcaacaagatcttagtcacaggcaggtctgaatcaattatgaagctggaggaaaggacaggggtcagctgggatctaggcgtagaagatgcctctgaatctaaattactcactgtctctattatggatttgtcacaaatgtactcccctgtttttgagtacttgtcaggagacagacaggttgaggaatggcccaaagcaacgtgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtgaaagacctttttacagatcacatgtttgtcaaatggaaggttgaatatataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgagattatcacgttgcatcccaaagttgaagaaggcttctttgacttgatgcatgtacaaaaagtgttgtctgcaagtacagtgtgtaaactgcaaagctgcacacatggtataccaggagatctacaagtttaccacattggcaacttgctgaaaggtgatagagtaaacgggcatctaattcacaaaattgaaccacatttcaacacctcttggatgtcctgggatggttgtgacttagactactactgcaacatgggggattggccttcttgcacatacacaggagtgacccagcataaccatgctgcatttgtaaacttgcttaacattgaaactgattacacgaaaaccttccacttccactctaaaagagtcacagcacatggtgacacaccacaattagacttaaaagcaaggccgacctacggtgcaggtgagatcactgtgctggttgaagttgctgatatggagctgcataccaagaaagttgagatatcaggcttgaaatttgcaagtctagcttgcacgggttgctatgcttgtagctctggcatctcctgtaaagtcaggattcatgtagatgagccagatgagctcacagtacatgtaaagagcagtgatcctgatgtggttgcagctagcacaagtctcacggcgaggaagcttgaatttgggacagacagcacattcaaggccttttcagctatgcccaagacctctttatgtttttacattgtggagaaagaatactgcaagagctgcaatgaagatgacacacaaaaatgtgttgacacaaagcttgagcagccacagagcatactaattgagcacaaaggaacgataattggaaagcagaatgatacttgcacagccaaggcaagctgttggctggagtcagtcaagagttttttttatggattaaagaatatgcttggtagtgtctttggtaattttttcataggcattttgttattccttgccccttttgtcctgttggtgcttttctttatgtttggatggaaaatcttgttttgctttaaatgttgcaggaggaccagaggcttatttaagtatagacacctcaaagacgatgaggaaacaggctacaaaaggattattgaaagattgaacaacaaaaaagggaaaaacagactgcttgatggtgaaaggttggctgataggaaaattgctgagctgttctccacaaaaacacacattggttaa

SEQ ID NO: 3554 - RNA, 5067 nt, synthetic construct
  misc_feature 1..5067: note = derived and/or modified CDS sequence (wt) from CCHFV(Haskovo-V46/13)__KR092379.1__GP
  source 1..5067: mol_type = other RNA
atgcccaccaacattatgcatacactattagtgtgcttcattctttacctacagctgttgggtctaggaggagctcatggacagtcaaacacaactgaacacaatggaacaaacaacaccacagcacccggcacaagccaaagccccaagccacacatgagcacaaccccaccacacgcaccggaatcatccaccatcaaacccaccacgccaacaagcgaaacagaaggctcaggggaaacgaccccaccctcaaataccacccagggcccgtccccaccagagaccacatcggaacgccctgcaacaaccgccataagcacgtcaagcacagacaacatgaaccccacctcacagatgactgacaacacccccacatcaacagtcagcataagcccatccagcagccccagcacgccatccacaccacaaggcatgcatcatcctgcaaggagtctattgtcagtctcgagccctaagacagcaacaacaccaacaccaacgagccctgtagaggtgggctcggaaaccagcagtcagcactcagccatgagcagtacaccaaccccccacacagcaactcaggtctccactgagaacaccaaccacagcacacctagacaatctgagccctcagcacagcagacaaccccaagcccaatgccttccccagcgcaatcgacccttctaatgagtgctgcccctacagctgttcagaacacacatcccagcccaacgaacaggtctaagaggaaccttgagatggaaataattttaactctgtcacaaggtctaaagaaatactacggtaagatactgaagcttctgcatctcaccttagaagaggacaccgaaggcctgttggaatggtgtaagagaaaccttgggtcaaactgtgatgatgacttctttcaaaagagaatagaagaattcttcatgactggtgagggctactttaatgaagtcttacaatttaaaacactaagcacactaagccccatggagccgtctcatgctgagctaccaacagcagaacccttcaaatcttacttcgctaagggcttcctttcaatagattcgggctacttctctgccaaatgttatccaagatcatctacttcagggcttcagctgatcaatgttacccaacacccagctaggatagcagaaacacctggacccaagacaacgagtctgaaagccatcaactgtataaacctaagagcatcagtcttcaaagaacacagagaaattgagatcaatgtgcttcttcctcagattgcagtcaacctctcaaactgccatgttgtgatcaattcacatgtctgtgattactctttagacactgatgggccagtgaggcttcctcacatttatcatgaagggaccttcataccaggaacttataaaatagtgatagacaaaaaaaataagctaaatgaccgatgtacactggtcaccaactgtgtgataaagggaagagaggttcgcaagggccaatcggtgctgaggcagtacaaaacagaaatcaagataggcaaggcatcaacaggctctaggaaactactgtccgaagagctaggtgatgactgtatatcaagaactcagctattgaggacagaaacagcagagatacatgatgacaactatggtggtccaggtgataaaataactatctgcaatggttcaaccattgtagatcagagactgggcagtgaactaggatgttataccatcaacagggggaagtcattcaagctatgcgaaaacagcgctacagggaaaacctgtgagatagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggagatatcctagtggactgttcaggtgggcagcaacatttcttaaaagacaacttaattgacctagggtgcccccatatcccgctattgggtaagatggctatttacatttgcagaatgtctaatcatcctagaacaaccatggcttttctcttctggtttagctttggctatgtgatcacttgtatattttgcaaggctcttttttattcattgataattattgggacactagggaaaaaaatcaagcaatatagggaactgaaacctcaaacctgcaccatatgtgagacaactcctgtcaatgcaatagatgctgaaatgcatgacctcaactgtagttacaatatatgcccttattgtgcatcaagattgacctccgatgggctagccaggcatgtaacacaatgccccaagcggaaagagaaagttgaggagactgaactgtacctgaacctggaaagaattccttggattgtcagaaagctattgcaggtgtcagagtccaccggtgtggcattgaaacgaagcagctggctgattgtactgcttgtgttactcccagtttcattgtcgccggttcaatcagcacctgttggtcatggaaagacaatcgaaacatatcagaccagagaaggattcacaagcatctgtctctttatgttaggaagcattctatttatagtttcttgcttggtgaaagggctggttgacagtgttggtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagctacacttgagtatctgcaaaaaaaggaaaacggggagcaatgtcatgctggctgtctgcaaacgcatgtgctttagggcaaccatagaagcaagcagaagagccttgctcatccgaagcattatcaataccacttttgcaatgtgcattctaacattgacaatctgtgttgttagcacctctgcagtagagatggaaaaccttccagcaggtacttgggagagagaggaagacctgacaaatttctgtcatcaggaatgccaggtaactgagacggagtgcctctgtccatacgaagctcttgtgctcagaaagccccttttcttagacagtatagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttagtcacaggcaggtctgaatcaatcatgaaactagaggaaaggacaggagtcagctgggatctaggcgtagaagatgcctcagaatccaaattacttaccgtttctatcatggatttatcacaaatgtattcccctgtttttgagtacttgtcaggggacagacaggttgaagaatggccaaaagcaacttgtacaggtgattgcccagaaaggtgtggctgcacatcatcaacctgcttacataaagaatggcctcactcaagaaactggagatgcaatcccacttggtgctggggagtaggaaccggctgcacctgttgcggggtggatgtaaaagacctttttacggatcacatgttcgtcaaatggaaagttgaatacataaaaactgaagccatagtatgtgttgagctcaccagccaagaaagacagtgcagtctgattgaggcaggtactagattcaacttgggccctgtgactattaccctgtctgagccaagaaacattcagcagaagcttccccctgaaattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaaccacatttcaacacctcttggatgtcctgggatggttgtgatttagattactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattggacttaaaagcaaggccgacctacggtgcaggtgagatcactgtgctggttgaggttgctgacatggagttgcataccaagaaagttgaaatatcaggcttgaaatttgcaagtttgacttgcacgggttgctatgcttgtagctctggcatctcctgcaaagttaggattcatgtagatgaaccagatgagcttacagtacatgtaaagagcagtgatcctgatgtggttgcagctggcacaagtcttatggcgaggaagcttgaatttggaacagacagcacattcaaggccttttcagctatgcccaaaacctctttatgtttttacattgtggagagagaatactgcaagagctgcagtgaagatgatacacaaaaatgtgttgacacaaaacttgagcagccacagagcatactaattgagcacaaaggaacaataattggaaagcagaatgatacttgcacagccagggcaagctgttggctagagtcagtcaagagttttttttatggattgaagaatatgcttggcagtgtttttggtaattttttaataggcattttgttattccttgccccttttgtcctgttggtgcttttctttatgtttgggtggaaaatcttgttttgctttaaatgttgcaggaggaccagaggcttattcaaatatagacacctcaaagacgatgaggaaacaggctacagaaggattattgaaagactgaacagcaaaaaagggaaaaacagactgcttgatggtgaaaggctggctgataggaaaattgctgagctgttctccacaaaaacacacattggctaa

SEQ ID NO: 3555 - RNA, 5067 nt, synthetic construct
  misc_feature 1..5067: note = derived and/or modified CDS sequence (wt) from CCHFV(VLG/TI29414)__AY179961.1__GP
  source 1..5067: mol_type = other RNA
atgcctaccaacattatgcatacgctattagtgtgcttcattctttacctacagctgttgggtctaggaggagctcatatacagtcaaacgcaactgaacacaacggaacaaacaccaccacagcacccagcacaagtcaaagccccaagccacttgtgagcacagccccaccacacgcactggaatcatccaccatcaaacccaccacaccagtaagcgaaacagaaggctcagggggaacgaccccacccccaaacaccacccagggcccgtctccaccagaggccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggatataagctcagaaaccagcagtctgcactcagccatgagcagaacatcaaccctctacacagcaacccaggtctccactgaaaatgccaaccacagcgcacctagacagtctgagtcctcagcacagcagacaaccacaagcccaatgacttccccagcacaaccaatccttgtaatgagtgctgctcctacagctattcagaacatacatcccagcccaacgaataggtctaagaggaaccttgagatggaaataattttaactctgtctcaaggtctaaagaaatactatggtaagatactgaagcttctgcacctcaccttggaagaggacactgaaggcctgttagaatggtgtaagagaagccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagattatctacttcagggcttcagctgatcaatgtcacccaacacccagctagaatagcagaaacacctggacccaagacaacaagtctgaaaaccatcaactgtataaacctaagagcatcagtcttcaaagaacacagagaaattgagatcaatgtgctccttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgagggcagaaccagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaatttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagcccctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaagagactgagctgtacttgaacctggaaagaattccttggaatgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcatcagttacacttgagtatctgcaaaaaaagaaaaatgggtagcaatgtcatgctggccgtctgcaagcgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttactaaactcaacaaacttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctgggaagtaggaactggctgcacctgctgcgggtggaatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgctgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggaatgacccagcataaccatgctgcatttgtaaacttgcttaatatcgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcaatgatccagatgtgattgcagctagcacaagtctcatggcgaggaagcttgaatttgggacagacagtacattcaaggccttttcagctatgcccaaaacctctttatgtttttacattgcggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagactcctcaaagacgatgaggaaacaggctacagaaggattattgaaagactgaacaacaaaaaaggaaaaaacagactgcttgatggtgaaaggttggctgataggaaaattgctgagctgttctccacgaaaacacacattggttaa

SEQ ID NO: 3556 - RNA, 5067 nt, synthetic construct
  misc_feature 1..5067: note = derived and/or modified CDS sequence (wt) from CCHFV(UCCR4405)__KY484029.1__GP
  source 1..5067: mol_type = other RNA
atgcccatcaacattatgcatgcactattagtgtgcttcattctttacctacagctatcgggtttaggaggagctcatagacagtcaaacgcaactgaacacaatggaacaaacaccaccacagcacccggcacaagtcaaagccctaagccacccgtgagcaccactctaccacacacaccagaagcctccaccatcaaactcaccacaccaacaagcgaaacagaaggctcaggggaaacgaccccacccccaaacaccacccagggcctgcccctaccagggaccacaccagaacgctccgcaacaaccgccacaagcacgtcaagcacagacgacatgaattccaccacacagatgaccgacaacacccccacatcaacagtcagcataggtctatccagcagccccagcatgccatccacatcacaaggcatacattatcccgtaaggagtctattgtcagtctcgagccctaagacagcaacaacaccaacaccaatgagccctggagaggtgagcccggaaaccagcagtcagcactcagccatgagcagaataccaaccctctacacagcaacccaggtctccactgagaacaccaaccgcagcatacctagacaatctgagtcctcagtgcagccggcaacccaaagcccaataacttccccagcgcaaacaatccttctgatgagtgctgctcctacagctattcaggacatgcatcccagcccaaaaaacaggtccaagaggaaccttgaggtggaaataattttaactctgtctcaaggtctaaagaaatattacggcaaaatactgaagcttctgcaccttaccttggaagaggatactgaaggcctgttagaatggtgtaagagaaaccttgggtcgaattgtgatgatgacttctttcaaaagagaatagaagaattcttcataactggtgagggctacttcaatgaagtcctacaatttaaaacaccaagcacactaagccccacggagccgtctcatgtcaggctaccaacagcagagcccttcaaatcttacttcgctaagggcttcctttcaatagattctggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtgctttcataccaggaacttataaaatagtgatagacaaaaaaaataagctaaatgaccgatgctcgctagtcactaactgtgtaataaagggaagagaggttcgtaagggccaatcagtgctgaggcagtacaaaacagaaatcaagataggcaaggcatcaacaggctctaggaaactactgtctgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaagtaatgatacctaaaggcactggagatatcctagtagactgttcaggtggacagcagcatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttactcattgataattattgggacactagggaaaaaaatcaagcaatatagggagctgaaacctcaaacttgcaccatatgtgagacagctcctgtcaatgcaatagatgctgaaatgcatgacctcaaatgtagttacaatatatgcccttattgtgcatcaagattgacctctgatgggctagctaggcatgtgacacaatgccctaagcgaaaggagaaagttgaggagactgaactgtacttgaacctggaaagaattccttggatagtcagaaagctattgcaagtgtcagagtccactggtgtagcattgaaacgaagcagttggctgattgtgctgcttgtgttactcacagtctcattgtcaccggttcaatcagcacctgttggtcatggtaagacaattgaaacatatcagaccagagaaggattcacaagtatctgtctctttatgttaggaagcatcctattcatagtctcttgcctagtaaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactactctgctgacagagaaattcaccagttgcacttgagtatctgcaaaaaaaggaaaacggggagcaatgtcatgctggctgtctgcaaacgcatgtgctttaaggcaactatagaagcaagcagaagagccctgctcatccgaagtattatcaacaccacttttgtaatatgtattctaatattagcaatctgtgttgttagcacctctgcagtagagatggaaaaccttccagcaggcacttgggagagagaggaagacctgacaaatttctgccaccaggaatgccaggtgaccgagacggaatgcctctgtccatacgaagctcttgtgctcaggaaacctcttttcttagacagtacagttaaaggtatgaaaaatttgctaaactcaacaagcttggaaacaagcttatcaattgaggcaccatggggagcaataaatgtccagtcaacctttaaaccaacagtatcgactgcaaacatagcactcagttggagctcagtggagcacagaggcaacaagatcttggtcacaggcaggtctgaatcaattatgaaactagaggaaaggacaggagtcagctgggatctaggcgtagaagatgcctctgaatccaaattacttaccgtctccatcatggatttgtcacaaatgtattcccctgtttttgagtacttatcaggagatagacaggttgaagaatggcccaaggcaacctgtacaggtgattgcccagaaaggtgtggctgcacatcatcaacctgcttgcataaagaatggcctcactcaagaaactggagatgtaaccccacttggtgctggggagtaggaaccggctgcacatgctgcggagtggatgtaaaagacctttttacagatcacatgtttgtcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtacaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatggggaattggccttcttgcacatacacaggagtgacccaacataatcatgctgcatttgtaaatttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggtttgcacgggttgctatgcttgtagctctggcatttcctgtaaagtcagaattcatgtagatgaaccagatgagctcacagtgcatgtaaagagcagtgatccagatgtggttgcagctagcacaagccttatggcaaggaagcttgaatttgggacagatagcatattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatgtttggatggaaaatcttgttttgctttaagtgttgcaggaggaccagaggcttgtttaagtatagacacctcaaagacgatgaggaaacaggctacagaaggattattgaaagactgaatagtaaaaaaggaaaaaacagactgcttgatggtgagaggttggctgataggaaaattgctgagctgttctccacaaaaacacacattggctaa

SEQ ID NO: 3557 - RNA, 5067 nt, synthetic construct
  misc_feature 1..5067: note = derived and/or modified CDS sequence (wt) from CCHFV(Ast133)__KX056060.1__GP
  source 1..5067: mol_type = other RNA
atgcccatcaacattaagcatacactattagtgtgcttcattctttacctacagctgtcgggtttaggaggagctcatggacagtcaaacgcaactgaacacaatggaacaaacaccaccacggtacccggcacaagtcaaagccccaagccacccgcgagcaccactccaccacacacaccagaatcctccaccgtcaaactcaccacaccaacaagcgaaacagaaggctcaggggaaacgaccccacccccaaacaccacccagggcctgcccctaccagggaccacaccagaacgctccgcaacaaccgccacaagcacgtcaagcacagacaacatgaattccaccacacaggtgaccgacaacacccccacatcaacagtcagtataagtccatccagcagccccagcatgccatccacatcacaaggcatacatcatccagtaaggagtctattgtcagtctcgagccctaagacagtaacaacaccgacaccaatgagccctggagagatgagcccggaaaccagcagtcagcactttgccatgagcagaataccaaccctctacacagcaacccaggtctccactgagaacaccgaccgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaaggggttcctttcaatagattcgggttacttctctgccaaatgttatccaagatcatccacttcagggcttcagctgatcaatgtcacccaacacccagctaggatagcagaaacacctggacccaaaacaacgagtctgaaaaccattaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaggaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactgctgtccgaagagccagatgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacttgtgagatagacagcactccggtcaagtgcagacaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggatttgaaattgaatcgcataaatgctactgtagtttattttgctgcccctactgtaggcactgctctgctgacagagaaattcaccagctgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttctcagacagtatagttaaaggtatgaaaaatttgctaaactcaacaagcttagaaacaagcttatcaattgaggcaccatggggagcaataaatgtccaatcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactattaccctgtctgagccaagaaacattcagcagaagcttccccctgagatcattacgctgcatcccaaaattgaagaaggcttctttgacttgatgcatgtgcaaaaagtgttatccgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaagaaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagtttttttgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaaggaaaaaacagactgcttgatggtgagaggttggctgataggaaaattgctgagctgttctcttcaaaaacacacattggctaa

SEQ ID NO: 3558 - RNA, 5067 nt, synthetic construct
  misc_feature 1..5067: note = derived and/or modified CDS sequence (wt) from CCHFV(Ast137)__KX056057.1__GP
  source 1..5067: mol_type = other RNA
atgcccatcaacatcatgcatacactattagtgtgcttcattctttacctacagctgtcgggtttaggaggagctcatggacagtcaaacgcaactgaacacaatggaacaaacaccaccacagtacccggcacaagtcaaagccccaagccacccgcaagcaccactctaccacacacaccagaatcctccaccgtcaaactcaccacaccaacaagcgaaacagaaggctcaggggaaacgaccccacccccaaacaccacccagggcctgcccccaccagggaccacaccagagcgccccgcaacaaccgccacaagcacgtcaagcacagacaacatgaactccaccacacaggtgaccgacaacacccccacatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcagcactcagccatgagcagaataccaaccctctacacagcagcccaggtctccactgagaacaccaaccgcagcacacctagacaatcagagtcctcagcacagccggcaacccaaagcccaacaactttcccagcgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgaaggctacttcaatgaagtcctacaatttaaaacactaagcacactaagccccacggagccgtctcatgtcaggctaccaacagcagagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgagggtactttcataccaggaacttataaaatagtgatagacaaaaaaaataagctaaatgaccgatgctcgctagtcactaactgtgtgataaagggaagagaggttcgtaagggccaatcagtactgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtggatcagagactgggcagtgaactagggtgttataccatcaacagggtgaagtcattcaagctatgcgaaaacagtgccacagggaaaacctgtgagatagacagcactccggtcaagtgcaggcaagggttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccattcacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttacctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctactcatccgaagcattatcaataccacttttgtaatatgcatcctaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtacgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttaatgcatgtgcaaaaagtgttatctgcaagtacagtgtgtaaactgcagagttgcacacatggtataccgggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagggtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3559 - RNA, 5067 nt, synthetic construct
  misc_feature 1..5067: note = derived and/or modified CDS sequence (wt) from CCHFV(Ast149)__KX056054.1__GP
  source 1..5067: mol_type = other RNA
atgcccatcaacatcatgcatacactattagtgtgcttcattctttacctacagctgtcgggtttaggaggagctcatggacagtcaaacgcaactgaacacaacggaacaaacaccaccacagcacccggcacaagtcaaagccccaagccacccgcgagcaccactccaccacacacaccagaatcctccaccgtcaaactcaccacaccaacgagcgaaacagaaggctcaggggaaacgaccccacccccaaacaccacccagggcctgcccccaccagggaccacaccagaacgccccgcaacaaccgccacaagcacgtcaagcacagacaacatgaactccaccacacaggtgaccgacaacacccccacatcaacagtcagcacaagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcagcactcagccatgagcagaataccaaccctctacacagcagcccaggtctccactgagaacgccaaccgcagcacacctagacaatcagagtcctcagcacagccggcaacccaaagcccaacaactttcccagcgcaaacaatccttctgatgagtgctgctcctaaagctattcaggacatgcatcccagcccaacaaacaggtccaagaggaaccttgaggtggaaataattttaactctgtctcaaggtctaaagaagtattatggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcagagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatctactcacatgtctgtgattactctttagacactgacgggccagtgaggcttcctcgcattcaccatgagggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcgttgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgaagcagctggctgattgtgctacttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctacccatccgaagcattatcaataccacttttgtaatatgcatactaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggcgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3560 - RNA, 5067 nt, synthetic construct
  misc_feature 1..5067: note = derived and/or modified CDS sequence (wt) from CCHFV(Ast199)__KX056051.1__GP
  source 1..5067: mol_type = other RNA
atgcccatcaacatcatgcatacactattagtgtgcttcattctttacctacagctgtcgggtttaggaggagctcatgtacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaaccacgtcaagcacagacaacatgaactccaccacacaggtgaccgacaacacccccacatcaacagtcagcataagtccatccagcaaccccagcatgccatccacatcacaaggcatacattatcccgtaaggagtctattgtcagtctcgagccccaagacagtaacaacaccgacaccaatgagccctggagagatgagcccggaaaccagcagtcagcactcagccatgagcagaataccaaccctctacacagcagcccaggtctccactgagaacaccaaccgcagcacacctagacaatcagagtcctcagcacagccggcaacccagagcccaacaactttcccagcgcaaacaatccccctgatgagtgctgctcccaaagccattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacaccaagcacactaagccccacggagccgtctcatgttaggctaccaacagcagagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgagggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttacaccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgcgaaataatgatacctaaaggcactggagatatcctagtagactgttcaggtggacagcaacatttcttaaaagacaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtgtcagagtccactggtgtggcattgaaacgatgcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtaaaggggctggttgacagtgtcagtgacagcttcttccccggcctatctgtctgtaagacatgctctattggcagtataaatggctttgaaattgaatcgcacaaatgctactgtagtttattttgctgcccctactgtaggcactgctctgctgacagagaaattcaccagctgcacttgggtatctgcaaaaaaagaaaaacggggagcaatgtcatgctggctgtctgcaagcgcatgtgctttaaggcaaccatagaagcaagcagaagagccctactcatccgaagcattatcaataccacttttgtaatatgcatcctaacattagcaatctgtgttgttagcacctctgcagtagagatggaaaatcttccagcaggcacttgggagagagaggaagacctgacaaatttctgccatcaggaatgccaggtaaccgagacggaatgcctctgtccatacgaagctcttgtgctcaggaaacctcttttcttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaaggaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgaggtatcaggcttgaaatttgcaagtctggcttgcacgggttgctatgcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttgtgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtaattttttcgtaggcattttgttattccttgccccttttgtcttgttggtgcttttctttatatttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3561 - RNA, 5067 nt, synthetic construct
  misc_feature 1..5067: note = derived and/or modified CDS sequence (wt) from CCHFV(Saf)__KX013487.1__GP
  source 1..5067: mol_type = other RNA
atgcctaccaacattatgcatacactattagtgtgcttcattctttacctacagctgttgggtctaggaggagctcatggacagtcaaacgcaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccctaagacagcaacaacaccaacaccaacgagccctggggagataagctcagaaaccagcagtctgcactcagccatgagcagaacatcaaccctctacacagcaacccaggtctccactgaaaatgccaaccacagcgcacctagacagtctgagtcctcagcacagccgacaaccacaagcccaatgacttccccagcacaatcaatccttgtaatgagtgctgcccctacagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacattcaccatgaagggactttcataccaggaacttataaaatagtgatagacaaagaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacattacttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacggctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttctcagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgagactgattacatgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgtaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3562 - RNA, 5067 nt, synthetic construct
  misc_feature 1..5067: note = derived and/or modified CDS sequence (wt) from CCHFV(Min)__KX013481.1__GP
  source 1..5067: mol_type = other RNA
atgcctaccaacattatgcatacactattagtgtgcttcattctttacctacagctgttgggtctaggaggagctcatggacagtcaaacgcaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacaccacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatctattgtcagtctcgagccttaagacagcaacaacaccaacaccaacgagccctggggagataagctcagaaaccagcagtctgcactcagccatgagcagaacatcaaccctctacacagcaacccaggtctccactgaaaatgccaaccacagcgcacctagacagtctgagtcctcagcacagccgacaaccacaagtccaatgacttccccagcacaatcaatccttgtaatgagtgctgctcctatagctattcagaacatacatcccagcccaacgaataggtctaagaggaaccttgagatggaaataattttaactctgtctcaaggtctaaagaaatactacggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgttacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcgttcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgttttggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgcaaggctcttttttattcattgataattattgggacactagggaaaaagatcaagcaatatagggaattgaaacctcaaacttgtactatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattgaaacgaagcagctggctgattgtactgcttgtgttactcacagtttcattgtcaccggttcaatcagcacctgttggtcatggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgcactattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcacgaagaatttgctaaactcaacaagcttagaaacaagcttatcaattgaggcaccatggggagcaataaatgtccagtcaacctttaaaccaacagtgtcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcctacttggtgctggggagtaggaactggctgcacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggggataggataaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaaggcaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3563 - RNA, 5067 nt, synthetic construct
  misc_feature 1..5067: note = derived and/or modified CDS sequence (wt) from CCHFV(Mamon)__KX013478.1__GP
  source 1..5067: mol_type = other RNA
atgcctaccaacattatgcatacactattagtgtgcttcattctttacctacagctgttgggtctaggaggagctcatggacagtcaaacacaactgaacacaacggaacaaacaccaccacagcacccagcacaagtcaaagccccaagccacttgtgagcacagccccaccacacgcactggaatcatccaccatcaaacccaccacaccagcaagcgaaacagaaggctcaggggaaacgaccccacccccaaacatcacccagggcccgtctccaccagagaccacaccagaacgccccgcaacaactgccacaagtacgccaagcacagacaacacgaattccaccacacatgtgaccgacaacaaccctacatcaacaatcagcacaagtccatccagcagccccagcacgccatccacaccacaaggcatacatcatcctgcaaggaatttattgtcagtctcgagccctaagacagcaacaacaccaacaccaacgagccctggggagataagctcaaaaaccagcagtctgcactcagccatgagcagaacatcaaccctctacacagcaacccaggtctccactgaaaatgccaaccacagcgcacctagacagtctgagtcctcagcacagccgacaaccacaagcccaatgacttccccagcacaatcaatccttgtaatgagtgctgctcctacagctattcagaacatacatcccagcccaacgaatagatctaagaggaaccttgagatggaaataattttaactctgtctcaaggtctaaagaaatactatggtaagatactgaagcttctgcacctcaccttggaagaggacactgaaggcctgttagaatggtgtaagagaaaccttgggtcaaactgtgatgatgacttctttcagaagagaatagaagaattcttcatgaccggtgagggctacttcaatgaagtcttacaatttaaaacactaagcacactaagccccacggagccgtctcatgccaggccaccaacagtggaacccttcaaatcttacttcgctaagggcttcctttcaatagattcaggttacttctctgccaaatgttatccaagatcatctacttcagggcttcagctgatcaatgtgacccaacacccagctagaatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattattctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaggagccaggtgatgactgcatatcaagaactcagctattgaggacagaaacagcagagatccatgatgacaactatggtggtccaggtgataaaataactatctgcaatggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtttcggatgcttgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactgtggcttttctcttctggttcagctttggctatgtgatcacctgtatattttgcaaggctcttttttattcattgataattattgggacactagggaaaaagatcaagcaatatagggaattgaaacctcaaacttgtaccatatgtgagacagctcctgtcaatgcaatagacgctgaaatgcatgaccttaactgcagttacaatatatgcccttattgtgcatcaagattgacctccgatgggctagctaggcatgtgccacaatgccccaagcggaaggaaaaagttgaggagactgagctgtacttgaacctggaaagaattccttggattgtcagaaagctattgcaagtgtcagagtccactggtgtggcattaaaacgaagcagctggctgattgtactgcttgtgttactcacagtttcattgtcaccggttcaatcagcacctgttggtcacggtaagacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattataaataccacttttgtaatatgcattttaacattgacaatctgtgttgttagcacctctgcagtagagatggaaaaccttccatcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtagaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgcacctgctgcggggtggatgtaaaagacctttttacagatcacatgtttgtcaaatggaaggttgaatatataaaaactgaagccatagtgtgtgttgagctcaccagccaggaaagacagtgcagtctgattgaggcaggtactagattcaacttgggccctgtgactattaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatctacaagtttaccacattggcaacttgctgaaaggtgatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctcgttgaggttgctgacatggagttgcataccaagaaagttgagatatcaggcttaaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagagagaatactgcaagagctgcagtgaagaggacacacaaaaatgtgttgacacaaaacttgagcagccacagagcatactaattgagcacaaaggaacgataattggaaagcagaatgatacttgcacagccaagacaagctgttggctagagtcagtcaagagttttttttatggattgaaaaatatgcttggtagtgtatttggtaactttttcataggcattttgttattccttgccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaaggaaaaaacagactgcttgatggtgaaaggttggctgataggaaaattgctgagctgttctccacaaaaacacacattggttaa

SEQ ID NO: 3564 - RNA, 5067 nt, synthetic construct
  misc_feature 1..5067: note = derived and/or modified CDS sequence (wt) from CCHFV(K340_6)__KX013475.1__GP
  source 1..5067: mol_type = other RNA
atgcctatcaacattatgcatacactattagtgtgcttcattctttacctacagctgtcgggtttaggaggagctcatgtacagtcaaacgcaactgaacacaatggaacaaacaccaccacagcacccggcacaagtcaaagccccaagccacccgcgagcaccactctaccacacacaccagaatcctccaccgtcaaacccaccacaccaacaagcgaaacagaaggctcaggggaaacgaccccacccccaaacaccacccagggcctgcccccaacagggaccacaccagaacgctccgcaacaaccgccacaagcacgtcaagcacagacaacatgaactccaccacacaggtgaccgacagcacccccacatcaacagtcagcacaagtccatccagcagctccagcatgccatccacatcacaaggcatacatcatcccgtaaggagtctattgtcagtctcgagccctaagacagtaacaacaccgacaccaatgagccctggagagatgagcccggaaaccagcagtcagcactcagccatgagcagagtaccaaccctctacacagcaacccaggtctccactgagaacaccgaccgcagcacacctagacaatctgagtcctcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacagaaaaaataagctaaatgaccgatgctcgctagtcactaactgtgtgataaaaggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtctttcaagctatgcgaaaacagtaccacagggaaaacctgtgagatagacagcactccggtcaagtgcaggcaaggcttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgccattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctggctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgttgcccctactgtaggcactgctctgctgacagagaaattcaccagttgcacttgagtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatgtgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacccctttccttagacagtatagttaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacggccatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttactgacatggagttgcataccaaaaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctagagtcagtcaagagttttttttatggattgaagaatatgcttggcagtgtttttggtagttttttcgtaggcattttgttattccttgcccctttcgtcttgttggtgcttttctttatgtttggatggaaaatcttgttttgctttaagtgttgcaggaggaccagaggcttgtttaagtatagacacttcaaagatgacgaggaaacaggctacagaaggattattgaaagactgaacagcaaaaaaggaaaaaacagactgcttgatggtgagaggttggctgataggaaaattgctgagctgttctctacaaaaacacacattggctaa

SEQ ID NO: 3565 - RNA, 5067 nt, synthetic construct
  misc_feature 1..5067: note = derived and/or modified CDS sequence (wt) from CCHFV(K323_27)__KX013472.1__GP
  source 1..5067: mol_type = other RNA
atgcccatcaacattatgcatacactattagtgtgcttcattctttacctacagctgtcaggtttaggaggagctcatggacagtcaaatgcaactgaacacaatggaacaaacaccaccacagtacccggcacaagtcaaagccccaagccacccgcgagcaccactctaccacacacaccagaatcctccaccgtcaagctcaccacaccaacaagcgaaacagaaggctcaggggaaacgaccccacccccaaacaccacccagggcctgcccctaccagggaccacaccagaacgctccgcaacaaccgccacaagcacgtcaagcacagacaacatgaattccaccacacaggtgaccgacaacacccccacatcaacagtcagcataagtccatccagcagccccagcatgccatccacatcacaaggcatacatcatcccgtaaggagtctattgtcagtctcgagccctaagacagtaacaacaccgacaccaatgagccctggagagatgagcccggaaaccagcagtcagcactcagccatgagcagaataccaaccctctacacagcaacccaggtctccactgagaacaccgaccgcagcacacctagacaatctgagtcctcagtacagccggcaacccaaagcccaataacttccccagcgcaaacaatccttctgatgagtgctgctcccaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaagaattcttcataactggtgagggctacttcaatgaagtcctacaatttaaaacactaagcacactaagccccacggagtcgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcagctcacatgtctgtgattactctttagacactgacggaccagtgaggctccctcgcattcaccatgaaggtactttcataccaggaacttataaaatagtgatagacagaaaagataagctaaatgaccgatgctcgctagtcactaactgtgtgataaagggaagagaggttcgtaagggccaatcagtgctgaggcagtacaaaacagaaattaagataggcaaggcatcaacaggctctaggaagctactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaagctcttttttatttattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgactgtgctgcttgtgttactcacagtctcattgtcaccggtccaatcagcacctgttggccatggtaatacaatcgaaacatatcagaccagagagggattcacaagtatctgtctctttatgttaggaagcatcctattcatagtttcttgcctggtaaaggggctggttgacagtgtcagtgacagcttcttccccggcctgtctgtctgtaagacatgctctattggcagtataaatggctttgaaattgaatcgcataaatgctactgtagtttattttgctgcccccactgtaggcaccgctctgctgacagagaaattcaccagttgcacttgagtatctgcaaaaaaagaaaaacggggagcaatgtcatgctggctgtctgcaagcgcatgtgccccaaggcaaccatagaagcaagcagaagagccctgcccatccgaagcatcatcaacaccactcttgtaatgtgcattctaacattagcaatctgtgttgttagcacctctgcagtagagatggaagaccttccagcaggcacctgggagagagaggaagacctaacaaatttctgccatcaggaatgccaggtgaccgagacggaatgcctctgtccatacgaagctcttgtgctcaggaaacctcttttcttagacagtatagccaaaggtatgaaaaatttgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggatttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatacataaaaaccgaagccatagtatgtgttgagctcaccggccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacattggcaacttgttgaaaggggatagagtaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcttgtagctctggcatctcctgtaaagtcagaattcatgtagatgaaccagatgagctcacagtgcatgtaaagagcagtgatccagatgttgttgcagctagcacaagccttatggcaaggaagcttgaatttgggacagatagcacattcaaggcattttcagctatgcccaaaacctctttatgcttttacattgtggagagggaatactgcaagagctgcagtgaagatgatacaaaaaaatgtgttgacacaaaacttgagcagccacagagcatactaattgagcacaaagggacgataattggaaagcagaatgatacttgcacagccaaggcaagttgttggctggagtcagtcaagagttttttttatggattgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaatgatgacgaggaaacaggctacagaaggatcattgaaagactgaacagcaaaaaaggaaaaaacagactgcttgatggtgagaggttggctgataggaaaattgctgagctgttctctacaaaaacacacattggctaa

SEQ ID NO: 3566 - RNA, 5067 nt, synthetic construct
  misc_feature 1..5067: note = derived and/or modified CDS sequence (wt) from CCHFV(K315_14)__KX013469.1__GP
  source 1..5067: mol_type = other RNA
atgcccttcaacattatgcatacactattagtgtgcttcattctttacctacagctgtcgggtttaggaggggctcatggacagtcaaacgaaactgaacacaatggaacaaacaccaccacagtacccggcacaagtcaaagccccaagccacccgcgagcaccactctacaacacacaccagaatcctccaccgtcaaactcaccacaccaacaagcgaaacagaaggctcaggggaaacgaccccacccccaaacaccacccagggcctgcccccaccagggaccacaccagaacgctccgcaacaaccgccacaagcacgtcaagcacagacaacatgaattccaccacacaggtgaccgacaacacccccacatcaacagtcagcataagtccatccagcagccccagcatgccatccacatcacaaggcatacattatcccataaggagtctattgtcagtctcgagccctaagacagtaacaacaccgacaccaataagccctggagagatgagcccggaaaccagcagtcagcactcagccatgagcagaataccaaccctctacacagcaacccaggtctccactgagaacaccaaccgcagcacacctagacaatctgagtcttcagtacagccggcaacccaaagcccaataacttccccagcgcaaacaatccttctgatgagtgctgctcctaaagctattcaggacatgcatcccagcccaacaaacaggtccaagaggaaccttgaggtggaaataattttaactctgtctcaaggtctaaagaaatattacggtaaaatactgaagcttctgcaccttaccttggaagaggatactgaaggcctgttagaatggtgtaagagaaaccttgggtcaaattgtgatgatgacttctttcaaaagagaatagaggaattcttcataactggtgagggctacttcaatgaagtcctacaatttaaaacactaagcacactaagccccacggagccgtctcatgtcaggctaccaacagcggagcccttcaaatcttacttcgctaagggcttcctttcaatagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattagaataggcaaggcatcaacaggctctaggaaactactgtccgaagagccaggtgacgactgcatatcaagaactcagctattgaagacagaaacagcagaaatccatgacgacaactatggtggtccaggtgacaaaataactatctgcaatggttcaaccgttgtggatcagagactgggcagtgaactagggtgttataccatcaacagggtgaagtcattcaagctatgcaaaaacagtgccacagggaaaacctgtgagatagacagcactccggtcaagtgcaggcaaggtttttgtttgaaaatcacccaagagggaaggggccacgtaaaattatccaggggctcagaggttgttttggatgtttgcgactcgagctgtgaaataatgatacctaaaggcactggagatatcctagtagactgttcaggtggacagcaacatttcttaaaagacaacttgattgacctagggtgccctcatatcccgctattgggtaaaatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgaagggctagctaggcatgtgacacaatgccctaagcgaaaggagaaagttgaggagactgaactgtatttgaacctggaaagaattccttggatagtcagaaagctattgcaagtgtcagagtccactggtgtggcattgaaacgaagcagttggctgattgtgctgcttgtgttactcacagtctcattgtcaccggtccaatcagcacctgttggtcatggtaagacaatcgaaacatatcagaccagagaaggattcacaagtatctgtctctttatgttaggaagcatcctattcatagtttcttgcctggtaaaggggctggtttacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgagtatctgcaaaaaaagaaaaacagggagcaatgtcatgctggctgtctgcaagcgcatgtgctttaaggcaaccatagaagcaagcagaagagccctgctcatccgaagcattatcaataccacttttgtaatatgcattctaacattagcaatctgtgttgttagcacctctgcagtagagatggaagaccttccagcaggcacttgggagagagaggaagacctaacaaatttctgccatcaggaatgccaggtgaccgagacggaatgcctctgtccatacgaagctcttgtgctcaggaaacctcttttcttagacagtatagttaaaggtatgaaaaaattgctaaactcaacaagcttagaaacaagcttatcaattgaggcaccatggggagcaataaatgtccagtcaacctttaaaccaacagtatctactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacttgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcattcaagaaactggagatgtaatcccacttggtgctggggagtaggaaccggctgcacatgctgcggagtggatgtaaaagacctttttacagaccacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcccaaaattgaagaaggcttctttgacttgatgcatgtgcaaaaagtgttatctgcaagtacagtgtgtaaactgcagagttgcacacatggtataccaggagatctacaaatttaccacatcggtaacttgttgaaaggggatagagtaaacgggcatctgattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctgacttgtacgggttgctatgcctgtagctctggcatctcctgtaaagtcagaattcatgtagatgaaccagatgagctcacagtgcatgtaaagagcagtgatccagatgtggttgcagctagcacaagccttatggcaaggaagcttgaatttgggacagatagcacattcaaggcattttcagccatgcccaaaacctctttatgcttttacattgtagagagggaatactgcaagagctgcagtgaagatgatacaaaaaaatgtgttgacacaaaacttgagcagccacagagcatactaattgagcacaaggggacaataattggaaagcagaatgatacttgcacagccaaggcaagttgttggctagagtcagtcaagagttttttttatggactgaagaatatgcttggcagtgtttttggtagttttttcgtaggcattttgttattccttgccccttttgtcttgttggtgcttttctttatgtttggatggaaaatcttgttttgctttaagtgttgcaggaggaccagaggcttgtttaagtatagacacctcaaagatgacgaggaaacaggctacagaaggattattgaaagactgaacagcaaaaaagggaaaaacagactgcttgatggtgagaggttggctgataggaaaattgctgagctgttctctacaaaaacacacattggctaa

SEQ ID NO: 3567 - RNA, 5067 nt, synthetic construct
  misc_feature 1..5067: note = derived and/or modified CDS sequence (wt) from CCHFV(K229_243)__KX013466.1__GP
  source 1..5067: mol_type = other RNA
atgcctaccaacattatgcatacactattagtgtgcttcattctttacctacagctgttgggtctaggaggagctcaaggacagtcaaacgcaacagaacacaacgaaacaaacaccaccacagcacccagcacaagtcaaagtcccaagccacctgtgagcacaaccccaccacatgcactggaatcatccaccatcaaacccaccacaccagcaagagaaacagaaggctcaggggaaacgaccccacccccaaacaccacccagggcccgtctccaccagaggccacaccagaacgccccgcaacaactgccacaagtacgccaagcacagacaacacgaattccaccacacatgtgaccgacaacaaccctacatcaacaatcagcacaagtccatccagcagccccagcacgccattcacaccacaaggcatacatcatcctgcaaggaatctattgtcagtctcgagccctaagacagcaacaacaccaacaccaacgagccctagggagttaagctcagaaaccagcagtctgcactcagccataagcagaacatcaaccctctacacagcaacccaggtctctaccgaaaatgccaaccacagcgcacctagacagtctgagtcctcagcacagccgacaaccacaagcccaatgacttccccagcacaatcaatccttgtaatgagtgctgctcctacagctattcagaacatacatcccagcccgacgaataggtctaagaggaaccttgagatggaaataattttaactctgtctcaaggtctaaagaaatactacggtaagatactgaagcttctgcacctcaccttggaagaggacaccgaaggcctgttagaatggtgtaagagaaaccttgggtcaaactgtgatgatgacttctttcagaagagaatagaagaattcttcatgactggtgagggctacttcaatgaagtcttacaatttaaaacactaagcacactaagccccacggagccgtctcatgccaggccaccagcagtggaacccttcaaatcttacttcgctaagggcttcctttcaatagattcaggttacttctctgccaaatgttatccaagatcatctacttcagggcttcagctgatcaatgttacccaacacccagctaggatagcagaaacacctggacccaagacaacgagtctgaaaaccatcaactgtataaacctaagagcatcagtcttcaaagaacacagagaaattgagatcaatgtgcttcttcctcagattgcagtcaacctctcaaattgccatgttgtaatcaattcacatgtctgtgattactctttagacactgatgggccagtgaggcttcctcacatttaccatgaagggactttcataccaggaacttataaaatagtgatagacaaaaaaaataagctaaatgaccgatgtacactggtcaccaactgtgtgataaaaggaagagaggttcgtaagggccaatcagtgctgaggcagtacaaaacagaaatcaagataggcaaggcatcaacaggctctaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcgaaaacagcgccacagggaaaacctgtgagatagacagcactccggttaagtgcaggcaaggtttttgtttaaaaatcacccaagagggaaggggccacgtaaaattatctagaggctcagaggttgtcttggatgcctgcgactcaagctgcgaagtaatgatacctaaaggcactggagatatcctggtggactgttcaggtggacagcaacatttcttaaaagacaacttaattgacctagggtgcccccatatcccgctattgggtaaaatggccatttacatctgcagaatgtcaaatcatcctagaacaactatggcttttctcttctggttcagctttggctatgtgatcacctgtatattttgtaaggctcttttttattcattgataattattgggacactagggaaaaagatcaagcaatatagggaattgaaacctcaaacttgtaccatatgtgagacagctcctgtcaatgcaatagatgctgaaatgcatgaccttaactgcagttacaatatatgcccttattgtgcatcaagattgacctccgatgggctggctaggcatgtgccacaatgccccaagcggaaggaaaaagttgaggagactgagctgtacttgaacctggaaagaatcccttggattgtcagaaagctattgcaagtgtcagagtccactggtgtggcattgaaacgaagcagctggctgattgtactgcttgtgttactcacagtttcattgtcaccggttcaatcagcacctgttggtcatggtaaaacaatcgaaacatatcagaccagagaaggattcacaagtatctgtctctttatgttaggaagcatcctgtttttagtctcttgcttggtgaaggggctggttgacagtgtcagtgacagcttcttccccggcctgtctgtctgtaagacatgctctattggcagtataaatggctttgaaattgaatcgcataaatgctactgtagcctattttgctgcccctactgtaggcactgctctgctgacagagaaattcaccagttacacttgagtatctgcaaaaaaagaaaaacgggtagcaatgtcatgctggctgtctgcaaacgcatgtgctttagggcaaccatagaagcaagcagaagagccctgctcatccgaagcattatcaataccacttttgtaatatgcattttaacattgacaatctgtgttgttagcacctctgcagtagagatggaaaaccttccagcaggcacttgggagagagaggaagacctgacaaatttctgtcatcaggaatgccaggtaaccgagacggagtgcctctgtccatacgaagctcttgtgctcagaaaacctctgttcttagacagtatagttaaaggcatgaagaatttgctaaactcaacaagcttagaaacaagcttatcaattgaggcaccatggggagcaataaatgtccagtcaacctttaaaccaacagtatcgactgcaaacatagcactcagttggagctcagtggagcacaggggcaacaagatcttagtcacaggcaggtctgaatcaattatgaaactggaggaaaggacaggagtcagctgggatctaggcgtggaagatgcctctgaatccaaattacttaccgtctctatcatggatttgtcacaaatgtattcccctgtttttgagtacttgtcaggagacagacaggttgaagaatggcccaaagcaacttgcacaggtgactgcccagaaaggtgtggttgcacatcatcaacctgcttgcataaagaatggcctcactcaagaaactggagatgtaatcccacttggtgctggggagtaggaactggctgtacctgctgcggggtggatgtaaaagacctttttacagatcacatgtttgtcaaatggaaggttgaatatataaaaactgaagccatagtatgtgttgagctcaccagccaggaaagacagtgcagtctgattgaggcaggtactagattcaacttgggccctgtgactatcaccctgtctgagccaagaaacattcagcagaagcttccccctgagattatcacgttgcatcccaaagttgaagagggcttctttgacttgatgcatgtgcaaaaagtgttgtctgcaagtacagtgtgtaaactgcagagttgcacacatggtataccaggagatcttcaagtttaccacattggcaacttgctgaaaggggatagggtaaacgggcatctaattcacaaaattgaaccacatttcaacacctcttggatgtcctgggatggctgtgacttagactactactgcaacatgggggattggccttcttgcacatacacaggagtgacccagcataaccatgctgcatttgtaaacttgcttaacattgaaactgattacacgaaaaccttccacttccactctaaaagagttacagcacatggtgacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctatgcttgtagctctggcatctcctgtaaagtcaggattcatgtagatgagccagatgagctcacagtacatgtaaagagcagtgatccagatgtggttgcagctagcacaagtctcatggcgaggaagcttgaatttgggacagacagtacattcaaggccttttcagctatgcccaaaacctctttatgtttttacattgtggagaaagaatactgcaagagctgcagtgaagaggacacacaaaaatgtgttgacacaaaacttgagcagccacagagcatactaattgagcacaaaggaacgataattggaaagcagaatgatacttgcacagccaaagcaagctgttggctagagtcagtcaagagttttttttatggattgaagaatatgcttggtagtgtctttggtaactttttcataggcattttgttattccttaccccttttgtcctgttggtgcttttctttatgtttggatggaaaatcttgttttgcttcaaatgttgcaggaggaccagaggcttacttaagtatagacacctcaaagacgatgaggaaacaggctacagaaggattattgaaagactgaacaacaaaaaagggaaaaacagactgcttgatggtgaaaggttggctgataggaaaattgctgagctgttctccacaaaaacacacattggttaa

SEQ ID NO: 3568 - RNA, 5067 nt, synthetic construct
  misc_feature 1..5067: note = derived and/or modified CDS sequence (wt) from CCHFV(K229_194)__KX013463.1__GP
  source 1..5067: mol_type = other RNA
atgcccatcaacattatgcatacactattagtgtgcttcattctttacctacagctgtcgggtttaggaggagctcatggacagtcaaacgcaactgaacacaatggaacaaacaccaccacagtacccggcacaagtcaaagccccaagccacccgcgagcaccactctaccacacacaccagaatcctccaccgtcaaactcaccacaccaacaagcgaaacagaaggctcaggggaaacgaccccacccccaaacaccacccagggcctgcccccaccagggaccacaccagaacgccccgcaacaaccgccacaagcacgtcaagcacagacaacatgaattccaccacacaggtgaccgacaacacccccatatcaacagtcagcataagtccatccagcagccccagcatgccatccacatcacaaggcatacattatcccgtaaggagtctattgtcagtctcgagccctaagacagtaacaacaccgacaccaatgagccctggagagatgagcccggaaaccagcagtcaacactcagccatgagcagaataccaaccctctacacagcaacccaggtctccactgagaacaccaaccgcagcacacctagacaatccgagtcctcagcacagccggcaacccaaagcccaacaacttccccaacgcaaacaatccttctgatgagtgctgctcctaaagctattcaggacatgcatcccagcccaacaaacaggtccaagaggaaccttgaggtggaaataattttaactctgtctcaaggtctaaagaagtattacggtaaaatactgaagcttctgcaccttaccttggaagaggatactgaaggcctgttagagtggtgtaagagaaaccttgggtcaaattgtgatgatgacttctttcagaagagaatagaagaattcttcataactggtgagggctacttcaatgaagtcctacaatttaaaacactaaacacactaagccccacggagccgtctcatgtcaggctaccaacagcggagcccttcaaatcttacttcgctaagggcttcctttcagtagattcgggttacttctctgccaaatgttatccaagatcatccacttcagggcttcagctgatcaatgtcacccaacacccagctaggatagcagaaacacctggacccaaaacaacgagtctgaaaaccatcaactgtatcaacctaagagcatcagtcttcaaagaacacagagaagttgagatcaatgtgcttcttcctcagattgcagtcaacctctcaaactgccatgttgtgatcaactcacatgtctgtgattactctttagacactgacgggccagtgaggcttcctcgcattcaccatgaaggtactttcataccaggaacttataaaatagtgatagacaaaaaaaataagctaaatgaccgatgctcgctagtcactaactgtgtgataaagggaagagaggttcgtaagggccaatcagtgctgaggcagtacaaaacagaaattaagataggcaaggcatcaacaggctctaggaaactactgtccgaagagccaggtgacgactgcatatcaagaactcagctattgaagacagaaacagcagagatccatgacgacaactatggtggtccaggtgacaaaataactatctgcaatggttcaaccattgtagatcagagactgggcagtgaactagggtgttataccatcaacagggtgaagtcattcaagctatgcgaaaacagtgccacagggaaaacctgtgagatagacagcactccggtcaagtgcaggcaaggtttttgtttgaaaatcacccaagagggaaggggccacgtaaaattatccaggggctcagaggttgttttggatgcttgcgactcgagctgtgaaataatgatacctaaaggcactggagatatcctagtagactgttcaggtggacagcaacatttcttaaaaggcaacttgattgacctagggtgccctcatatcccgctattgggtaagatggccatttacatttgcagaatgtcaaatcatcccaggacaaccatggctttcctcttctggttcagttttggctatgtaatcacctgtatattttgcaaggctcttttttattcattgataattattgggacactagggaaaaaaatcaagcaatatagggagctaaaacctcaaacttgcaccatatgtgagacagctcctgtcaatgcaatagatgctgaaatgcatgacctcaactgtagttacaatatatgcccttattgtgcatcaagactgacctctgatgggctagctaggcatgtgacacaatgccctaagcgaaaggagaaagttgaggagactgaactgtatttgaacctggaaagaattccatggatagtcagaaagctgttgcaagtatcagagtccactggtgtggcattgaaacgaagcagctggctgattgtgctgcttgtgttactcacagtctcattgtcaccggttcaatcagcacctgttggtcatggtaagacaatcgaaacatatcagaccagagaaggattcacaaatatctgtctctttatgttaggaagcatcctattcatagtttcttgcctggtgaaggggctggttgacagtgtcagtgacagcttcttccccggcctgtctgtctgtaagacatgctctattggcagtataaatggctttgaaattgaatcgcataaatgctactgtagtttattttgctgcccctactgtaggcactgctctgctgacagagaaattcaccagttgcacttgggtatctgcaaaaaaagaaaaacggggagcaatgtcatgctggctgtctgcaagcgcatgtgctttaaggcaaccatagaagcaagcagaagagccctgctcatccgaagcattatcaataccacttttgtaatatgcatcctaacattagcaatctgtgttgttagcacctctgcagtagagatggaaaatcttccagcaggcacttgggagagagaggaagacctgacaagtttctgccatcaggaatgccaggtaaccgagacggaatgcctctgtccatacgaagctcttgtgctcaggaaacctctttttttagacagtatagttaaaggtaagaaaaatctgctaaactcaacaagcttagaaacaagcttatcaattgaggcaccatggggagcaataaatgtccagtcaacctttaaaccaacagtatcgactgcaaacatagcactcagttggagctcagtagagcacagaggcaacaagatcttggtcacaggcaggtctgaatcaattatgaaactagaggaaaggacaggagtcagctgggatctaggcgtagaagatgcctctgaatccaaattacttaccgtctctatcatggacctgtcacaaatgtattcccctgtttttgagtacttatcaggagatagacaggttgaagaatggcccaaggcaacctgcacaggtgattgcccagaaaggtgtggctgcacatcatcaacctgcttgcataaagaatggcctcactcaagaaactggagatgtaatcccacttggtgctggggagtaggaaccggctgcacatgctgcggagtggatgtaaaagacctttttacagatcacatgtttatcaaatggaaggttgaatatataaaaaccgaagccatagtatgtgttgagctcaccagccaagaaagacagtgcagtctgattgaggcaggtactagattcaacttgggtcctgtgactatcaccctgtctgagccaagaaacattcagcagaagcttccccctgagatcattacgctgcatcctaaaattgaagaaggcttctttgacttgatgcatgtgcaaaaagtgttatctgcaagtacagtgtgtaaactgcagagttgcacacatggtataccaggagatctacaaatttaccacattggcaacctgttgaaaggggatagattaaacgggcatctaattcacaaaattgaaccacattttaacacctcttggatgtcctgggatggttgtgacctagactactattgcaacatgggggattggccttcttgcacatacacaggagtgacccaacataatcatgctgcatttgtaaacttgcttaacattgaaactgattacacgaaaaccttccacttccactctaaaagagtcacagcacatggagacacaccacaattagacttaaaagcaaggccgacctacggtgcaggtgagatcactgtgctggttgaggttgctgacatggagttgcataccaagaaagttgagatatcaggcttgaaatttgcaagtctggcttgcacgggttgctattcttgtagctctggcatctcctgtaaagtcagaattcatgtagatgaaccggatgagctcacagtgcatgtaaagagcagtgatccagatgtggttgcagctagcacaagccttatggcaaggaagcttgaatttgggacagatagcacattcaaggcattttcagctatgcccaaaacctctttatgtttttacattgtggagagggaatactgcaagagctgcagtgaagatgatacaaaaaaatgtgttgacacaaaacttgagcagccacagagcatactaattgagcacaaagggacgataattggaaagcaaaatgacacttgcacagccaaggcaagttgttggctagagtcagtcaagagttttttttatggattgaagaatatgcttggcagtgtttttggtaattttttcgtaggcattttgttattccttgccccctttgtcttgttggtgcttttctttatgtttggatggaaaatcttgttttgctttaagtgttgcaggaggaccagaggcttgtttaagtatagacacctcaaagatgatgaggaaacaggctacagaaagattattgaaagactgaacagcaaaaaaggaaaaaacagactgcttgatggtgagaggttggctgataggaaaattgctgagctgttctctacaaaaacacacattggctaa

SEQ ID NO: 3569 - RNA, 5067 nt, synthetic construct
  misc_feature 1..5067: note = derived and/or modified CDS sequence (wt) from CCHFV(Gaib)__KX013445.1__GP
  source 1..5067: mol_type = other RNA
atgcccgtcagcatcatgtatataccattagtgtatgctgttatctacctacagctgtatggtttgggaggagcacatgggctgctcaacaagactgaacaaaatgaaacaggcattacagcgacgcacggaagggttcagggccctccatctgcaagcataacattgcctgtcacaccggatcctctttccgccacatcagcagcatcaaccagcggaccagagggttcaggggaggtgcctacatcaccttcaactatcacacaaggcctgacctcatctgaaaacacgccgcagctccccacagcaaccgacacaggtatatcaagcacaagcatcattgatgtcagtacacagacagctggagacacctccacaccaacagcccacacgagtttgcctaacagccctagtgcgccgttcacatcacaagacacacgtcatactgtaaggggtctactgacagtgaccagcaccaagtcggatgaagcatcaacactaacagacccaaaagaagcaagcacagaggccagaagccccagtccatccatcagcagaacaccaaccccatccccaacagtccaagcctccactgaaaacaatacccccagtacccccagacaacccgagcccaccacacggccagctctcccaagtccaacgacctcaccaacacagccaagcctctcacagagcgccacctccgcagccattcaggacatgcatcccagcccaacaaacaggtccagaaggaatcttgagatggaaataattttgactttatctcaaggcctgaagaagtattacggtaagatactaaaacttctggatctcaccctagaagaagatactgagggcctgctagagtggtgcaagagaaatcttgatctgacctgtgatgaaaatttctttctaaagagaatagaagagttttttttgtccggtgagggtcactttaatgaagttttgcagtttaaagcaccaagcacaatgagctccacagaaccgactcatgcagggccaccgacagttgaacctttcaaatcttactttgctaagggcttcctttcaatagattcaggttatttttctgccaaatgttatccaaggacttctaattcaggtcttcagttgatcaatgtcacccagcacacagctagaatagcagacacacctggacccaagatcaccaatgtaaagaccatcaattgtataaacttgaaggcatcagtctttaagaagcatagggaggttgaaatcaatgtgcttctccctcagattgcggtcaacctctcaaactgccacgtcctgatcaaatcacatgtctgtgactattctttaaacttcgatgggatggtgagactaccccgcatccaccatgaaggaacttttatacctggaacttacaaaatagtgatagataggaaaaacaagcaaaatgacagatgcaccttggtcaccaactgtgtaataaaaggaagggaagtccgtaagggccagtcagcactgaggcaatacaggacagagatcaaaattggcgaggcatctattggatctagaagactgctgtccgaagaatccagtgatgactgcatatcaagaactcagctattaaggacagagactgcagaaatccataatgataattatggagggccaggtgacaaaataactatttgtaatggttcaactattgtagatcaaaggctaggcagtgaactgggatgttacactatcaatagagtaaagtcatttaagctatgcgaaaacagtgctacagggaaatcctgtgaaatagatagcatccctgtaaagtgcaggcaagggttttgtttaaaaattactcaggagggaagaggccatgtgaagttgtcaagaggttcagaagttgtcttagatgcctgtgattcaagctgtgaaataatgataccaaaaggcaccggagacatcctagtggactgttcaggtgggcaacaacattttttaaaggataacttgattgacttagggtgtcccaatatcccactgttaggcaaaatggctatctacatttgtagaatgtctaatcatcccaaaacaaccatggcctttctcttttggtttagttttggttatgtgataacctgtatattttgcaaagccatcttttatttgttgataatcgtggggacacttggaaaaaagttcaaacagtatagagagttaaaacctcagacctgtaccatatgtgaaacaactcctgtcaacgcaatagacgctgaaatgcatgatcttaactgcagttacaatatatgcccttattgtgcatctagattaacctcagatggacttgccagacacgttgtgcactgccctaagcggaaggagaaaatagaagagactgaactgtacttaaacttagaaagagttccttgggttgttagaaaactacttcaggtgtctgaatcaactggtgtggcactgaagaggagcagttggctaattgtgctacttgtgctacttacagtctcattgtcaccagttcaatcagcacccatcggtcatggaaagacgattgagacttatcaaactagagaagggtacacaagcatttgtctatttgtactaggtggcatcttgtttatcgtctcttgcctaatgaaggggctggttgacagtgtcggcaataattttttccctgggttaactatctgcaaaacatgttccatcagcagtataaacggctttgaaattgaatcccacaaatgctactgtagtttactttgctgcccttattgtagacactgctctgctgacagagagatacatcagttgcacctaagtatctgcaaaaaaagaaaaacagggagtaatgtcatgttagccgtctgcaagcgcatgtgcttaagggtaactacagaagtaagcaacagggctctattcatccgaagcatcatcaacaccacatttgttatatgcatacttatactagcagtctgcgttatcagcacctccgcagtagagatggaaaacctgccagcaggcacctgggagagagaagaagacctaacaaacttctgtcaccaagaatgtcaagtaacggagactgaatgtctatgtccttacgaagctcttgtgctcaggaaacccctgttctcagacagcatagttaagggcatgaaaaacctgctgaactcaacaagtttagagacaagtttatcaattgaggcaccatggggagcgataaatgtccaatcaacctttaaacctactgtatcaactgcaaatatagcactcagttggagctcaatagagcacagaggcaacaagattctggtctcaggcagatcagagtcaatcatgaagctagaagagaggacaggaatcagctgggacctaggcgtggaagatgcttccgagtctaggttacttactgtttctgttatggatttgtcacaaatgtactctcccgtttttgaatacctgtcaggtgacagacaggtggaggaatggcctaaagcaacctgcacaggcgactgtcctgaaagatgtggatgcacatcgtcaacctgcttacacaaagaatggcctcattcaagaaattggagatgcaatcccacttggtgctggggagttggtaccgggtgcacctgctgtggactagatgtaaaagacctttttacagactatatgtttgtcaaatggaaagtcgagtacataaagacagaggctatagtgtgtgttgaacttacaagccaagaaaggcaatgcagtttgattgaggcaggcacaagattcaacttaggtccagtgaccatcacattgtcagaaccgagaaacattcagcaaaagcttcctcctgaaataatcacattgcaccctagaattgaagaaggcttctttgacctaatgcacgtgcagaaagtgctgtctgctagtacggtgtgtaaactacagagttgcacacacggtgtgccgggggatctacaggtctaccacattggcaatttgttaaaaggggataaggtgaacggacatctgattcacaagattgaaccacacttcaacacttcttggatgtcctgggatggttgtgacctggactactactgcaatatgggggattggccttcctgcacgtatactggagtaacccaacataaccacgccgcatttgtgaacctgctcaacattgaaactgattataccaaaaacttccacttccactctaagagagttactgcacatggagacacaccgcaattggatttgaaggctagaccaacctatggtgcaggcgagatcactgtgctggtagaagttgctgacatggagctacacacaaaaaagattgagatatcaggcctgaaatttgcgagtctaacttgcacaggttgctatgcttgcagctctggcatctcctgtaaagttaggatccatgtagatgaaccagatgagcttacagtgcatgtgaaaagtgaagatccagacatagttgcagctagctcaagtctcatggcaaggaagcttgaatttggtacagacagtacctttaaagccttttcagctatgcccaaaacctctttatgcttttacattgtagagagagaatattgcaagagctgcagtagagaagacacacaaaaatgtgtcagcacaaaacttgagcaaccacagagcattttaattgaacacaaaggaacgataatcggaaaacagaataacacctgcacaactaaaacaacctgttggttggaatcagtaaagagtttcttttatggactaaagaacatgcttagcagtatttttggcaatgttttcgtgggcattttctcattccttgcccctttcatcttactgatacttttcttcatgtttgggtggagaatcctattttgctttaagtgttgcagaaggactagaggcttatttaagtacagacatctcaaagacgatgaagagaccggttataggaggatcattgaaagattaaacaacaaaaaaggaaagagcaagttgcttgatggtgaaaggttggctgataggaagattgctgagctgttctccacaaaaacacacattggatga

SEQ ID NO: 3570 - RNA, 5067 nt, synthetic construct
  misc_feature 1..5067: note = derived and/or modified CDS sequence (wt) from CCHFV(Kosova Hoti)__EU037902.1__GP
  source 1..5067: mol_type = other RNA
atgcccatcaacattatgcatacactattagtgtgcttcattctttacctacagctgttgggtctaggaggagctcatggacagtcaaacgcaactgaacacaatggaacaaacaccaccacagcacccggcacaagtcaaagccccaagccacccgcgagcacaaccccatcacacgcaccggaaccatccaccatcaaactcaccacaccaacaagcgaaacagaaggctcaggggaaacgaccccacccacaaacaccacccaggactcgcccccgctagagaccacaccagaacgctctgcaacaaccgccacaagcacgtcaggcacagacaacatgaattccaccacacagatgaccgataacacccccacatcaacagtcagcacaagtctatccagtagccccagcacgccatccacatcacaaggcatgcaccatcccgtaaggagtctattgtcagtctcgagccccaagacagcaacaacaccaacaccaatgagccctggagagatgagctcggaaaccagcagtcagcactcagccatgagcagaacaccaaccccccacacagcaacccaggtctccactgagaacgccaaccgcagcacatccagacagtctgagtcctcagcacagccggcaacccaaagcccagtgacttccccagcgcaatcaatccttctgatgagtgctactcccacaaccattcagaacatacatcccagcccaacaaacaggtctaagaggaaccttgagatggaaataattttaactctgtctcaaggtctgaagaaatactatggtaaaatactgaagcttctgcaccttaccttggaagaggacactgaaggcttgttggaatggtgtaagagaaaccttgggtcgaactgtgatgatgacttctttcaaaagaggatagaagaattcttcataactggtgagggctacttcaacgaagttctacagtttaaaacactaagcacaccaagctccacggagccgtctcatgccaggctaccaacagcggaacccttcaaatcttacttcgctaagggcttcctttcaatagattcgggttacttctctgccaaatgttatccaagatcatccacttcagggcttcagctgatcaatgtcacccaacacccagctaggatagcagagacacctggacccaaaacaacgagtctgaaaaccatcaactgcatcaatctaagagcatctgtcttcaaagaacacagggaagttgagatcaatgtgcttcttcctcaaattgcagtcaacctctcaaactgccatgttgtgatcaattcacatgtctgtgattactctttagacactgatgggccagtgaggcttcctcgcatttaccatgaagggactttcatgccaggaacttataaaatagtgatagacagaaaaaataagctaaatgaccgatgtacgctagtcaccaactgtgtgataaaaggaagagaagttcgtaagggccaatcagtgctgaggcagtacaaaacagaaattaagataggcaaggcaccaacaggctctaggaaactactgtccgaagagccaggtgatgattgcatatcaaggactcagctattgaggacagaaacagcagagatccatgacgataactatggtggtccaggtgacaaaataactatctgcaatggttcaaccattgtagatcagagactgggcagtgaactagggtgttacaccatcaacagggtgaagtcattcaagctatgcgaaaacagcgccacagggaaaacctgtgagatagacagcactccagttaagtgcaggcaaggtttttgtttaaaaatcacccaaaagggaaggggccacgtaaaattatctagaggctcagaggttgtcttggacgcttgcgactcaaactgtgaagtaatgatacctaaaggcactggagatatcctagtggactgttcaggtggacagcagcatttcttaaaagacaacttgattgacctggggtgccctcatatcccactattgggtaagatggccatttacatttgcagaatgtcaaatcatcctaaaacaaccatggcttttctcttctggttcagctttggttatgtgatcacctgtatattttgcaaggctcttttttattcattgataattattgggacactaggaaaaaagatcaagcaatatagggaactgaaacctcaaacttgcaccatatgtgaaacagctcctgtcaatgcaatagatgctgaaatgcatgacctcaactgtagttacaatatatgcccttattgtgcatcaagattgacctccgatgggctagctaggcatgtaaagcaatgccctaagcgaaaggagaaagtcgaggagactgagctgtacctgaacctggaaagaattccttgggtcgtcagaaagctattgcaagtgtcagagtccactggtgtggcattgaaacgaagcagttggctgattgtgctgcttgtgttactcacagtttcattgtcaccggttcaatcagcacctgttggtcatggtaagacgatcgaaacatatcagaccagagaaggattcacaagtatttgtctctttatgttaggaagcatcctattcatagtctcttgcttggtgaaagggctggttgacagtgtcagtgacagcttcttccccggcctgtctgtctgcaagacatgctccattggcagtataaatggctttgaaattgaatcgcataaatgctactgtagcttattttgctgcccctattgtagacactgctctgctgacagagaaattcaccaattgcacttgaatatctgcaaaaaaagaaaaacggggagcaatgtcatgctagctgtctgcaagcgcatgtgctttagggcaaccatagaagcaagcagaagagccctgctcatccgaagtattatcaataccacttttgtaatatgcattctaacattaacaatctgtgttgttagtacctctgcagtagagatggaaaaccttccagcaggcacctgggagagagaggaagacctgacaaatttttgtcatcaggaatgccaggtaaccgagacggaatgcctttgtccatacgaagctcttgtgctcaggaaacctcttttcttagacagtatagtcaaaggtatgaaaaatttgctaaactcaacaagcttagaaacaagcttatcaattgaggcaccatggggagcaataaatgtccagtcaaccttcaaaccaacagtgtcgactgcgaacatagcactcagttggagctcagtggaacacagaggcaacaagatcttagtcacaggcaggtctgagtcaattatgaaactagaggaaaggacaggaatcagctgggatctaggcgtagaagatgcctctgaatccaaattacttaccgtctctatcatggatttgtcacagatgtattccccagtttttgagtacttgtcaggggacagacaggttgaagaatggcccaaagcaacttgcacaggtgactgcccacaaaggtgtggctgcacatcatcaacctgcttgcataaagaatggcctcattcaagaaactggagatgtaatcccacttggtgctggggagtgggaactggctgcacctgctgcggggtggatgtaaaagacctttttacagatcacatgtttgtcaaatggaaggttgaatatataaaaactgaagccatagtgtgtgttgagctcaccagccaagaaagacagtgcagtctgattgaggcaggtactagattcaacttgggccctgtgactattaccctgtctgagccaagaaacattcagcagaagctcccccctgagatcattacgttgcatcccaaaattgaggaaggcttctttgacttgatgcatgtacaaaaagtgttgtccgcaagtacagtgtgtaaactgcagagttgcacacatggtataccaggagatctacaagtttaccacattggcaatttgttgaaaggggatagagtgaacgggcatctaattcacaaaattgaaccacatttcaacacctcttggatgtcctgggatggttgtgacttagactactactgcaacatgggggactggccttcttgtacatacacaggagtgacccagcataatcatgctgcatttgtaaacttgctcaacattgaaactgattacacaaaaaccttccacttccactctaaaagagtcacagcacatggtgacacaccacaattggacttaaaagcaaggccgacctacggtgcaggagagatcactgtgctggttgaggttgctgacatggagttgcataccaagaaagttgagatatcgggcttgaaatttgcaagtctggcttgcacaggttgctatgcctgtagctctggtatctcctgtaaagtcaggattcatgtagatgaaccagatgagctcacagtgcatgtaaagagcagtgatccagatgtggttgcagctggcacaagcctcatggcaaggaagcttgaatttgggacagacagcacattcaaggccttttcagctatgcccaaaacctctttatgtttttacattgtggagaaagaatactgcaagagctgcagtgaagatgatacaaaaaaatgtgttgacacaaaacttgagcagccacagagcatactaattgagcacagagggacgataattggaaagcagaatgatacttgcacagccaaggcaagctgttggctagagtcagtcaagagttttttttatggattgaagaatatgcttggcagtgtttttggtaattttttcataggtattttgttattccttgccccttttgtcctgttggtgcttttctttatgtttggatggaaaatcttgttttgctttaaatgttgcaggaggaccagaggcttgtttaagtatagacacctcaaagacgatgaggaaacaggctacagaaggattattgaaaggctgaacaacaaaaaagggaaaaatagactgcttgatggtgaaaggttggctgataggaaaattgccgagctgttttccacaaaaacacacattggctaa
